US007642348B2

(12) United States Patent
Bentwich et al.

(10) Patent No.: US 7,642,348 B2
(45) Date of Patent: Jan. 5, 2010

(54) PROSTATE CANCER-RELATED NUCLEIC ACIDS

(75) Inventors: Itzhak Bentwich, Mishgav (IL); Amir Avniel, Moshav Magshimim (IL); Yael Karov, Tel Aviv (IL); Ranit Aharonov, Tel Aviv (IL)

(73) Assignee: Rosetta Genomics Ltd, Rehovot (IL)

( * ) Notice: Subject to any disclaimer, the term of this patent is extended or adjusted under 35 U.S.C. 154(b) by 173 days.

(21) Appl. No.: 11/429,720

(22) Filed: May 8, 2006

(65) Prior Publication Data

US 2007/0259352 A1 Nov. 8, 2007

Related U.S. Application Data

(63) Continuation-in-part of application No. 11/130,645, filed on May 16, 2005.

(60) Provisional application No. 60/665,094, filed on Mar. 25, 2005, provisional application No. 60/522,457, filed on Oct. 4, 2004.

(51) Int. Cl.
*C07H 21/04* (2006.01)

(52) U.S. Cl. .................. 536/24.5; 536/24.31; 536/24.1; 514/44; 435/325; 435/375; 435/6

(58) Field of Classification Search ........................ None
See application file for complete search history.

(56) References Cited

U.S. PATENT DOCUMENTS

2008/0171715 A1* 7/2008 Brown et al. .................... 514/44
2008/0269072 A1* 10/2008 Hart et al. ...................... 506/16

FOREIGN PATENT DOCUMENTS

WO WO2006/119266 * 9/2006

OTHER PUBLICATIONS

Jains, K. Applications of biochip and microarray systems in pharmacogenomics. Pharmacogenomics, 2000, vol. 1(3): 289-307.*
Brummelkamp et al. A system for stable expression of short interfering RNAs in mammalian cells. Science 2002, vol. 296: 550-553.*
Lagos-Quintana, M., R. Rauhut, W. Lendeckel and T. Tuschl. Identification of novel genes coding for small expressed RNAs. Science, Oct. 26, 2001; (284)853-858.
Lagos-Quintana, M., R. Rauhut, A. Yalcin, J. Meyer, W. Lendeckel and T. Tuschl. Identification of tissue-specific microRNAs from mouse. Curr. Biol. Apr. 30, 2002. (12)735-739.
Dostie, J., Z. Mourelatos, M. Yang, A. Sharma and G. Dreyfuss. Numerous microRNPs in neuronal cells containing novel microRNAs. RNA, Feb. 2003, (9)180-186.
Lagos-Quintana, M., R. Rauhut, J. Meyer, A. Borkhardt and T. Tuschl. New microRNAs from mouse and human. RNA, Feb. 2003, (9)175-179.
Lim, L. P., M. E. Glasner, S. Yekta, C. B. Burge and D. P. Bartel. Vertebrate microRNA genes. Science, Mar. 7, 2003, 1540 299.
Michael, M. Z., O. C. SM, N. G. Van Holst Pellekaan, G. P. Young and R. J. James. Reduced accumulation of specific microRNAs in colorectal neoplasia. Mol. Cancer. Res., Oct. 2003, (1)882-891.
Bentwich, I., A. Avniel, Y. Karov, R. Aharonov, S. Gilad, O. Barad, A. Barzilai, P. Einat, U. Einav, E. Meiri, E. Sharon, Y. Spector and Z. Bentwich. Identification of hundreds of conserved and nonconserved human microRNAs. Nat. Genet., Jun. 19, 2005.
Fu, H., Y. Tie, C. Xu, Z. Zhang, J. Zhu, Y. Shi, H. Jiang, Z. Sun and X. Zheng. Identification of human fetal liver miRNAs by a novel method. FEBS Lett., Jul. 4, 2005, (578)3848-3854.
Murakami, Y., Yasuda, T., Saigo, K., Urashima, T., Toyoda, H., Okanoue, T., Shimotohno, K. Comprehensive analysis of microRNA expression patterns in hepatocellular carcinoma and non-tumorous tissues. Oncogene, Oct. 25, 2005, pp. 1-9.
Volinia, S., Caliln, G.A., Liu, C., Ambs, S., Cimmino, A., Petrocca, F., Visone, R., Iorio, M., Roldo, C. Ferracin, M. Prueitt, R., Yanaihara, N., Lanza, G., Scarpa, A., Vecchione, A., Negrini, M., Harris C.C., Croce, G.M. A microRNA expression signature of human solid tumors defines cancer gene targets. PNAS, Feb. 14, 2006, 2257-2261, 103.
Lu, J., Getz, G., Miska, E.A., Alvarez-Saavedra, E., Lamb, J., Peck, D., Sweet-Cardero, A., Ebert, B.L., Mak, R.H., Ferrando, A.A., Downing, J.R., Jacks, T., Horvitz, H.R. and Golub, T.R. MicroRNA expression profiles classify human cancers. Nature, Jun. 9, 2005, 834-838, 435.
Yanaihara, N., Caplen, N., Bowman, E., Seike, M., Kumamoto, K., Yi, M., Stephens, R. M., Okamoto, A., Yokota, J., Tanaka, TO, Calin, G. A., Liu, C., Croce, C. M. and Harris, C. C. Unique microRNA molecular profiles in lung cancer diagnosis and prognosis Cancer Cell Mar. 13, 2006 189-198.
Takamizawa, J., Konishi, H., Yanagisawa, J., Tomida, S., Osada, H., Endoh, H., Harano, T., Yatabe, Y., Nagino, M., Nimura, Y., Mitsudomi, T. and Takahashi, T. Reduced expression of the let-7 microRNAs in human lung cancers in association with shortened postoperative survival Advances in Brief Jun. 1, 2004 3753-3756 64.
Hayashita, Y., Osada, H., Tatematsu, Y., Yamada, H., Yanagisawa, K., Tomida, S., Yatabe, Y., Kawahara, K., Sekido, Y. and Takahashi, T. A polycistronic microRNA cluster, miR-17-92, is overexposed in human lung cancers and enhances cell proliferation AACR Journals Nov. 1, 2005 9628-9632 65.

* cited by examiner

Primary Examiner—Kimberly Chong
(74) Attorney, Agent, or Firm—Teddy C. Scott, Jr.; Polsinelli Shughart PC

(57) ABSTRACT

Described herein are novel polynucleotides associated with prostate cancer. The polynucleotides are miRNAs, miRNA precursors, and associated nucleic acids. Methods and compositions are described that can be used for diagnosis, prognosis, and treatment of prostate cancer. Also described herein are methods that can be used to identify modulators of the disease-associated polynucleotides. Also described herein are methods and compositions for linear amplification and labeling of a targeted nucleic acid. The amplified targeted molecules may be used in hybridization techniques like Luminex and Microarray analysis.

6 Claims, 1 Drawing Sheet

PROSTATE CANCER-RELATED NUCLEIC ACIDS

CROSS-REFERENCES TO RELATED APPLICATIONS

This application is a continuation-in-part of U.S. patent application Ser. No. 11/130,645, filed May 16, 2005, which claims the benefit of U.S. Provisional Application No. 60/665,094, filed Mar. 25, 2005, and U.S. Provisional Application No. 60/522,457, filed Oct. 4, 2004.

FIELD OF THE INVENTION

The invention relates in general to microRNA molecules as well as various nucleic acid molecules relating thereto or derived therefrom.

BACKGROUND OF THE INVENTION

MicroRNAs (miRNAs) are short RNA oligonucleotides of approximately 22 nucleotides that are involved in gene regulation. MicroRNAs regulate gene expression by targeting mRNAs for cleavage or translational repression. Although miRNAs are present in a wide range of species including *C. elegans, Drosophila* and humans, they have only recently been identified. More importantly, the role of miRNAs in the development and progression of disease has only recently become appreciated. Deregulated miRNA expression is implicated in onset and progression of different diseases including, but not limited to embryonic malformations and cancers.

As a result of their small size, miRNAs have been difficult to identify using standard methodologies. A limited number of miRNAs have been identified by extracting large quantities of RNA. MiRNAs have also been identified that contribute to the presentation of visibly discernable phenotypes. Expression array data shows that miRNAs are expressed in different developmental stages or in different tissues. The restriction of miRNAs to certain tissues or at limited developmental stages indicates that the miRNAs identified to date are likely only a small fraction of the total miRNAs.

Computational approaches have recently been developed to identify the remainder of miRNAs in the genome. Tools such as MiRscan and MiRseeker have identified miRNAs that were later experimentally confirmed. Based on these computational tools, it has been estimated that the human genome contains 200-255 miRNA genes. These estimates are based on an assumption, however, that the miRNAs remaining to be identified will have the same properties as those miRNAs already identified. Based on the fundamental importance of miRNAs in mammalian biology and disease, the art needs to identify unknown miRNAs. The present invention satisfies this need and provides a significant number of miRNAs and uses thereof.

Moreover, because of their potential broad use in treating and diagnosing different diseases, there is a need in the art (yet unmet) to develop methods of identification, isolation and also quatitation of miRNAs. The present invention addresses the need by disclosing efficient and sensitive methods and compositions for isolating and quantitating miRNAs from different samples, including those wherein there is only minimum amount of a starting material available.

SUMMARY OF THE INVENTION

An isolated nucleic acid is provided. The nucleic acid may comprise a sequence of any of SEQ ID NOS: 1-3751, the complement thereof, or a sequence at least 81% identical to 21 contiguous nucleotides thereof. The nucleic acid may be from about 51 to about 250 nucleotides in length. The nucleic acid many comprise a modified base.

A probe comprising the nucleic acid is also provided. A composition comprising the probe is also provided. A biochip comprising the probe is also provided.

A method for detecting a disease-associated nucleic acid is also provided. A biological sample may be provided from which the level of a nucleic acid may be measured. The nucleic acid may comprise a sequence of any of SEQ ID NOS: 1-3751. The nucleic acid may also comprise a sequence at least about 81% identical to about 21 contiguous nucleotides of any of SEQ ID NOS: 1-3751. A level of the nucleic acid higher than that of a control may be indicative of a disease.

A method for identifying compound that modulates expression of a disease-associated miRNA is also provided. A cell is provided that is capable of expressing a nucleic acid comprising a sequence of any of SEQ ID NOS: 1-20. A cell may also be provided that is capable of expressing a nucleic acid comprising a sequence at least about 81% identical to about 21 contiguous nucleotides of any of SEQ ID NOS: 1-20. The cell may be contacted with a candidate modulator. The level of expression of the nucleic acid may then be measured. A difference in the level of the nucleic acid compared to a control identifies the compound as a modulator of expression of the miRNA.

A method of inhibiting expression of a target gene in a cell is also provided. A nucleic acid may be introduced into the cell in an amount sufficient to inhibit expression of the target gene. The target gene may comprise a binding site substantially identical to a binding site referred to in Table 4 or any of SEQ ID NOS: 21-3751. The nucleic acid may comprise a sequence of any of SEQ ID NOS: 1-20 or a variant thereof. The nucleic acid may also comprise a sequence at least about 81% identical to about 21 contiguous nucleotides of any of SEQ ID NOS: 1-20 or a variant thereof. Expression of the target gene may be inhibited in vitro or in vivo.

A method of increasing expression of a target gene in a cell is also provided. A nucleic acid may be introduced into the cell in an amount sufficient to increase expression of the target gene. The target gene may comprise a binding site substantially identical to a binding site referred to in Table 4 or any of SEQ ID NOS: 21-3751. The nucleic acid may comprise a sequence substantially complementary to any SEQ ID NOS: 1-20 or a variant thereof. The nucleic acid may also comprise a sequence substantially complementary to a sequence at least about 81% identical to about 21 contiguous nucleotides of any of SEQ ID NOS: 1-20 or a variant thereof. Expression of the target gene may be increased in vitro or in vivo.

A method of treating a patient is also provided. The patient may suffer from a disorder set forth in Table 7. The patient may be administered a composition comprising a nucleic acid. The nucleic acid may comprise a sequence of any of SEQ ID NOS: 1-20, the complement thereof, or a sequence at least 81% identical to 21 contiguous nucleotides thereof. The nucleic acid may also comprise the sequence of any of SEQ ID NOS: 1-20, the complement thereof, or a sequence at least 63% identical to 81 contiguous nucleotides thereof. The nucleic acid may be from about 51 to about 250 nucleotides in length. The nucleic acid many comprise a modified base.

Also provided is a method of detecting a target nucleic acid. The targeted nucleic acid may be any nucleic acid, such as a miRNA. A nucleic acid comprising a short RNA sequence and a DNA sequence including a T7 RNA promoter sequence, may be ligated to the miRNA molecule. Another oligonucleotide may be annealed to the T7 promoter region to enable RNA polymerase binding to the double strand. Repeated cycles of initiation and product release may then be performed. As a result a linear amplification of the transcript that includes a complementary sequence to the original natural miRNA is achieved.

During the process of transcription, nucleotides that are labeled (e.g., biotinylated) may be incorporated to the transcript, which may be useful in the later detection of the transcript by a variety of assays. In the case of target nucleic acids expressed at low level, such as miRNAs, this method may provide detection of such target nucleic acids in methods such as Luminex. Using LNA (locked nucleic acid) in the probes that are bound to the Luminex microspheres may allow even more specific hybridization and increased signal strength.

BRIEF DESCRIPTION OF SEQUENCE LISTING AND TABLES

Reference is made to the appendix submitted on the two copies of the one compact disc submitted herewith. The compact disc contains the following: SEQ_01.txt (823 KB, May 08, 2006), which is the Sequence Listing, and the following tables: Table_01.txt (1 KB, May 07, 2006), Table_02.txt (2 KB, May 07, 2006), Table_03.txt (1 KB, May 07, 2006), Table_04.txt (83 KB, May 07, 2006), Table_05.txt (65 KB, May 07, 2006), Table_06.txt (5 KB, May 07, 2006), Table_07.txt (1 KB, May 07, 2006), Table_08.txt (233 KB, May 07, 2006), Table_09.txt (163 KB, May 07, 2006), Table_10.txt (2 KB, May 07, 2006), and Table_11.txt (9 KB, May 07, 2006), the contents of which are incorporated by reference herein.

DETAILED DESCRIPTION

Figure 1:
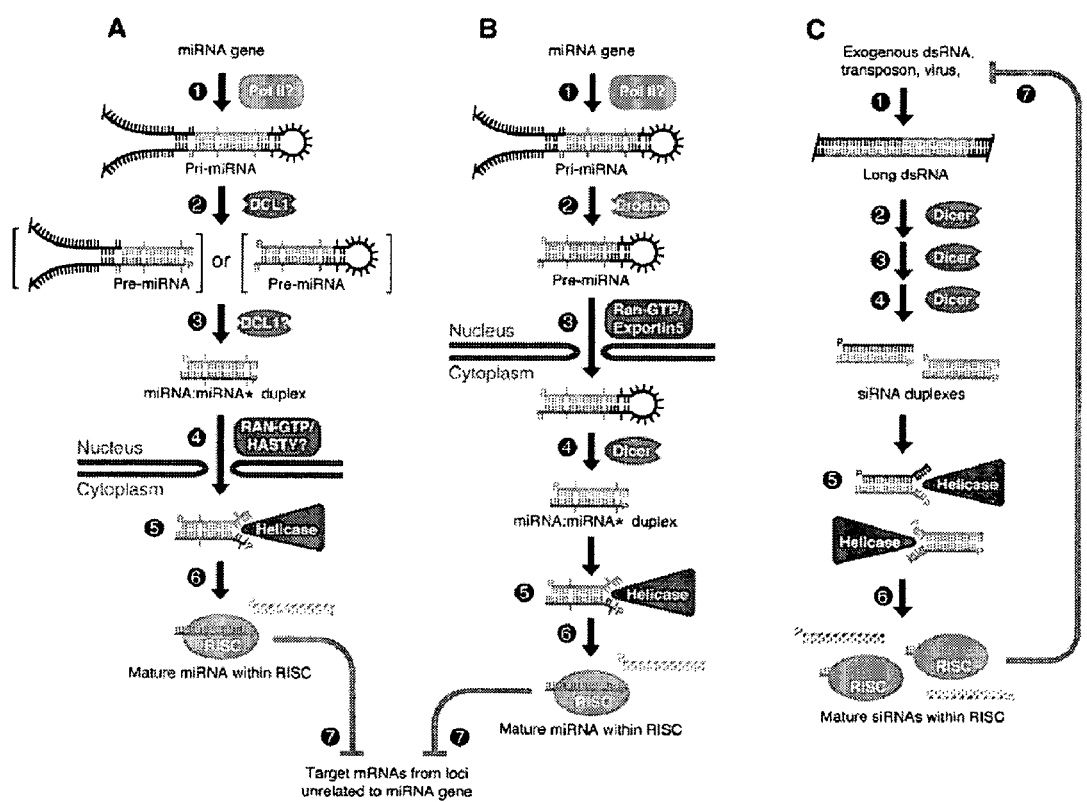
FIG. 1 demonstrates a model of maturation for miRNAs.

Nucleic acids are provided related to miRNAs, precursors thereto, and targets thereof. Such nucleic acids may be useful for diagnostic and prognostic purposes, and also for modifying target gene expression. Also provided are methods and compositions that may be useful, among other things, for diagnostic and prognostic purposes. Other aspects of the invention will become apparent to the skilled artisan by the following description of the invention.

1. Definitions

Before the present compounds, products and compositions and methods are disclosed and described, it is to be understood that the terminology used herein is for the purpose of describing particular embodiments only and is not intended to be limiting. It must be noted that, as used in the specification and the appended claims, the singular forms "a," "an" and "the" include plural referents unless the context clearly dictates otherwise.

a. Animal

"Animal" as used herein may mean fish, amphibians, reptiles, birds, and mammals, such as mice, rats, rabbits, goats, cats, dogs, cows, apes and humans.

b. Attached

"Attached" or "immobilized" as used herein to refer to a probe and a solid support may mean that the binding between the probe and the solid support is sufficient to be stable under conditions of binding, washing, analysis, and removal. The binding may be covalent or non-covalent. Covalent bonds may be formed directly between the probe and the solid support or may be formed by a cross linker or by inclusion of a specific reactive group on either the solid support or the probe or both molecules. Non-covalent binding may be one or more of electrostatic, hydrophilic, and hydrophobic interactions. Included in non-covalent binding is the covalent attachment of a molecule, such as streptavidin, to the support and the non-covalent binding of a biotinylated probe to the streptavidin. Immobilization may also involve a combination of covalent and non-covalent interactions.

c. Biological Sample

"Biological sample" as used herein may mean a sample of biological tissue or fluid that comprises nucleic acids. Such samples include, but are not limited to, tissue or fluid isolated from animals. Biological samples may also include sections of tissues such as biopsy and autopsy samples, frozen sections taken for histologic purposes, blood, plasma, serum, sputum, stool, tears, mucus, hair, and skin. Biological samples also include explants and primary and/or transformed cell cultures derived from animal or patient tissues. A biological sample may be provided by removing a sample of cells from an animal, but can also be accomplished by using previously isolated cells (e.g., isolated by another person, at another time, and/or for another purpose), or by performing the methods described herein in vivo. Archival tissues, such as those having treatment or outcome history, may also be used.

d. Complement

"Complement" or "complementary" as used herein to refer to a nucleic acid may mean Watson-Crick (e.g., A-T/U and C-G) or Hoogsteen base pairing between nucleotides or nucleotide analogs of nucleic acid molecules.

e. Differential Expression

"Differential expression" may mean qualitative or quantitative differences in the temporal and/or cellular gene expression patterns within and among cells and tissue. Thus, a differentially expressed gene may qualitatively have its expression altered, including an activation or inactivation, in, e.g., normal versus disease tissue. Genes may be turned on or turned off in a particular state, relative to another state thus permitting comparison of two or more states. A qualitatively regulated gene may exhibit an expression pattern within a state or cell type which may be detectable by standard techniques. Some genes may be expressed in one state or cell type, but not in both. Alternatively, the difference in expression may be quantitative, e.g., in that expression is modulated, either up-regulated, resulting in an increased amount of transcript, or down-regulated, resulting in a decreased amount of transcript. The degree to which expression differs need only be large enough to quantify via standard characterization techniques such as expression arrays, quantitative reverse transcriptase PCR, northern analysis, and RNase protection.

f. Gene

"Gene" used herein may be a natural (e.g., genomic) or synthetic gene comprising transcriptional and/or translational regulatory sequences and/or a coding region and/or non-translated sequences (e.g., introns, 5'- and 3'-untranslated sequences). The coding region of a gene may be a nucleotide sequence coding for an amino acid sequence or a functional RNA, such as tRNA, rRNA, catalytic RNA, siRNA, miRNA or antisense RNA. A gene may also be an mRNA or cDNA corresponding to the coding regions (e.g., exons and miRNA) optionally comprising 5'- or 3'-untranslated sequences linked thereto. A gene may also be an amplified nucleic acid molecule produced in vitro comprising all or a part of the coding region and/or 5'- or 3'-untranslated sequences linked thereto.

g. Host Cell

"Host cell" used herein may be a naturally occurring cell or a transformed cell that may contain a vector and may support replication of the vector. Host cells may be cultured cells, explants, cells in vivo, and the like. Host cells may be prokaryotic cells such as *E. coli*, or eukaryotic cells such as yeast, insect, amphibian, or mammalian cells, such as CHO and HeLa.

h. Identity

"Identical" or "identity" as used herein in the context of two or more nucleic acids or polypeptide sequences, may mean that the sequences have a specified percentage of residues that are the same over a specified region. The percentage may be calculated by optimally aligning the two sequences, comparing the two sequences over the specified region, determining the number of positions at which the identical residue occurs in both sequences to yield the number of matched positions, dividing the number of matched positions by the total number of positions in the specified region, and multiplying the result by 100 to yield the percentage of sequence identity. In cases where the two sequences are of different lengths or the alignment produces one or more staggered ends and the specified region of comparison includes only a single sequence, the residues of single sequence are included in the denominator but not the numerator of the calculation. When comparing DNA and RNA, thymine (T) and uracil (U) may be considered equivalent. Identity may be performed manually or by using a computer sequence algorithm such as BLAST or BLAST 2.0.

i. Label

"Label" as used herein may mean a composition detectable by spectroscopic, photochemical, biochemical, immunochemical, chemical, or other physical means. For example, useful labels include $^{32}$P, fluorescent dyes, electron-dense reagents, enzymes (e.g., as commonly used in an ELISA), biotin, digoxigenin, or haptens and other entities which can be made detectable. A label may be incorporated into nucleic acids and proteins at any position.

j. Nucleic Acid

"Nucleic acid" or "oligonucleotide" or "polynucleotide" used herein may mean at least two nucleotides covalently linked together. The depiction of a single strand also defines the sequence of the complementary strand. Thus, a nucleic acid also encompasses the complementary strand of a depicted single strand. Many variants of a nucleic acid may be used for the same purpose as a given nucleic acid. Thus, a nucleic acid also encompasses substantially identical nucleic acids and complements thereof. A single strand provides a probe that may hybridize to a target sequence under stringent hybridization conditions. Thus, a nucleic acid also encompasses a probe that hybridizes under stringent hybridization conditions.

Nucleic acids may be single stranded or double stranded, or may contain portions of both double stranded and single stranded sequence. The nucleic acid may be DNA, both genomic and cDNA, RNA, or a hybrid, where the nucleic acid may contain combinations of deoxyribo- and ribo-nucleotides, and combinations of bases including uracil, adenine, thymine, cytosine, guanine, inosine, xanthine hypoxanthine, isocytosine and isoguanine. Nucleic acids may be obtained by chemical synthesis methods or by recombinant methods.

A nucleic acid will generally contain phosphodiester bonds, although nucleic acid analogs may be included that may have at least one different linkage, e.g., phosphoramidate, phosphorothioate, phosphorodithioate, or O-methylphosphoroamidite linkages and peptide nucleic acid backbones and linkages. Other analog nucleic acids include those with positive backbones; non-ionic backbones, and non-ribose backbones, including those described in U.S. Pat. Nos. 5,235,033 and 5,034,506, which are incorporated by reference. Nucleic acids containing one or more non-naturally occurring or modified nucleotides are also included within one definition of nucleic acids. The modified nucleotide analog may be located for example at the 5'-end and/or the 3'-end of the nucleic acid molecule. Representative examples of nucleotide analogs may be selected from sugar- or backbone-modified ribonucleotides. It should be noted, however, that also nucleobase-modified ribonucleotides, i.e. ribonucleotides, containing a non-naturally occurring nucleobase instead of a naturally occurring nucleobase such as uridines or cytidines modified at the 5-position, e.g. 5-(2-amino)propyl uridine, 5-bromo uridine; adenosines and guanosines modified at the 8-position, e.g. 8-bromo guanosine; deaza nucleotides, e.g. 7-deaza-adenosine; O- and N-alkylated nucleotides, e.g. N6-methyl adenosine are suitable. The 2'-OH-group may be replaced by a group selected from H, OR, R, halo, SH, SR, $NH_2$, NHR, $NR_2$ or CN, wherein R is $C_1$-$C_6$ alkyl, alkenyl or alkynyl and halo is F, Cl, Br or I. Modified nucleotides also include nucleotides conjugated with cholesterol through, e.g., a hydroxyprolinol linkage as described in Krutzfeldt et al., Nature (Oct. 30, 2005), Soutschek et al., Nature 432:173-178 (2004), and U.S. Patent Publication No. 20050107325, which are incorporated herein by reference. Modified nucleotides and nucleic acids may also include locked nucleic acids (LNA), as described in U.S. Patent No. 20020115080, which is incorporated herein by reference. Additional modified nucleotides and nucleic acids are described in U.S. Patent Publication No. 20050182005, which is incorporated herein by reference. Modifications of the ribose-phosphate backbone may be done for a variety of reasons, e.g., to increase the stability and half-life of such molecules in physiological environments, to enhance diffusion across cell membranes, or as probes on a biochip. Mixtures of naturally occurring nucleic acids and analogs may be made; alternatively, mixtures of different nucleic acid analogs, and mixtures of naturally occurring nucleic acids and analogs may be made.

k. Operably Linked

"Operably linked" used herein may mean that expression of a gene is under the control of a promoter with which it is spatially connected. A promoter may be positioned 5' (upstream) or 3' (downstream) of a gene under its control. The distance between the promoter and a gene may be approximately the same as the distance between that promoter and the gene it controls in the gene from which the promoter is derived. As is known in the art, variation in this distance may be accommodated without loss of promoter function.

l. Probe

"Probe" as used herein may mean an oligonucleotide capable of binding to a target nucleic acid of complementary sequence through one or more types of chemical bonds, usually through complementary base pairing, usually through hydrogen bond formation. Probes may bind target sequences lacking complete complementarity with the probe sequence depending upon the stringency of the hybridization conditions. There may be any number of base pair mismatches which will interfere with hybridization between the target sequence and the single stranded nucleic acids described herein. However, if the number of mutations is so great that no hybridization can occur under even the least stringent of hybridization conditions, the sequence is not a complementary target sequence. A probe may be single stranded or partially single and partially double stranded. The strandedness of the probe is dictated by the structure, composition, and properties of the target sequence. Probes may be directly labeled or indirectly labeled such as with biotin to which a streptavidin complex may later bind.

m. Promoter

"Promoter" as used herein may mean a synthetic or naturally-derived molecule which is capable of conferring, activating or enhancing expression of a nucleic acid in a cell. A promoter may comprise one or more specific transcriptional regulatory sequences to further enhance expression and/or to alter the spatial expression and/or temporal expression of same. A promoter may also comprise distal enhancer or repressor elements, which can be located as much as several thousand base pairs from the start site of transcription. A promoter may be derived from sources including viral, bacterial, fungal, plants, insects, and animals. A promoter may regulate the expression of a gene component constitutively, or differentially with respect to cell, the tissue or organ in which expression occurs or, with respect to the developmental stage at which expression occurs, or in response to external stimuli such as physiological stresses, pathogens, metal ions, or inducing agents. Representative examples of promoters include the bacteriophage T7 promoter, bacteriophage T3 promoter, SP6 promoter, lac operator-promoter, tac promoter, SV40 late promoter, SV40 early promoter, RSV-LTR promoter, CMV IE promoter, SV40 early promoter or SV40 late promoter and the CMV IE promoter.

n. Selectable Marker

"Selectable marker" used herein may mean any gene which confers a phenotype on a host cell in which it is expressed to facilitate the identification and/or selection of cells which are transfected or transformed with a genetic construct. Representative examples of selectable markers include the ampicillin-resistance gene (Amp$^r$), tetracycline-resistance gene (Tc$^r$), bacterial kanamycin-resistance gene (Kan$^r$), zeocin resistance gene, the AURI-C gene which confers resistance to the antibiotic aureobasidin A, phosphinothricin-resistance gene, neomycin phosphotransferase gene (nptII), hygromycin-resistance gene, beta-glucuronidase (GUS) gene, chloramphenicol acetyltransferase (CAT) gene, green fluorescent protein (GFP)-encoding gene and luciferase gene.

o. Stringent Hybridization Conditions

"Stringent hybridization conditions" used herein may mean conditions under which a first nucleic acid sequence (e.g., probe) will hybridize to a second nucleic acid sequence (e.g., target), such as in a complex mixture of nucleic acids. Stringent conditions are sequence-dependent and will be different in different circumstances. Stringent conditions may be selected to be about 5-10° C. lower than the thermal melting point ($T_m$) for the specific sequence at a defined ionic strength pH. The $T_m$ may be the temperature (under defined ionic strength, pH, and nucleic concentration) at which 50% of the probes complementary to the target hybridize to the target sequence at equilibrium (as the target sequences are present in excess, at $T_m$, 50% of the probes are occupied at equilibrium). Stringent conditions may be those in which the salt concentration is less than about 1.0 M sodium ion, such as about 0.01-1.0 M sodium ion concentration (or other salts) at pH 7.0 to 8.3 and the temperature is at least about 30° C. for short probes (e.g., about 10-50 nucleotides) and at least about 60° C. for long probes (e.g., greater than about 50 nucleotides). Stringent conditions may also be achieved with the addition of destabilizing agents such as formamide. For selective or specific hybridization, a positive signal may be at least 2 to 10 times background hybridization. Exemplary stringent hybridization conditions include the following: 50% formamide, 5×SSC, and 1% SDS, incubating at 42° C., or, 5×SSC, 1% SDS, incubating at 65° C., with wash in 0.2×SSC, and 0.1% SDS at 65° C.

p. Substantially Complementary

"Substantially complementary" used herein may mean that a first sequence is at least 60%, 65%, 70%, 75%, 80%, 85%, 90%, 95%, 97%, 98% or 99% identical to the complement of a second sequence over a region of 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100 or more nucleotides, or that the two sequences hybridize under stringent hybridization conditions.

q. Substantially Identical

"Substantially identical" used herein may mean that a first and second sequence are at least 60%, 65%, 70%, 75%, 80%, 85%, 90%, 95%, 97%, 98% or 99% identical over a region of 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100 or more nucleotides or amino acids, or with respect to nucleic acids, if the first sequence is substantially complementary to the complement of the second sequence.

r. Target

"Target" as used herein may mean a polynucleotide that may be bound by one or more probes under stringent hybridization conditions.

s. Terminator

"Terminator" used herein may mean a sequence at the end of a transcriptional unit which signals termination of transcription. A terminator may be a 3'-non-translated DNA sequence containing a polyadenylation signal, which may facilitate the addition of polyadenylate sequences to the 3'-end of a primary transcript. A terminator may be derived from sources including viral, bacterial, fungal, plants, insects, and animals. Representative examples of terminators include the SV40 polyadenylation signal, HSV TK polyadenylation signal, CYC1 terminator, ADH terminator, SPA terminator, nopaline synthase (NOS) gene terminator of *Agrobacterium tumefaciens*, the terminator of the Cauliflower mosaic virus (CaMV) 35S gene, the zein gene terminator from *Zea mays*, the Rubisco small subunit gene (SSU) gene terminator sequences, subclover stunt virus (SCSV) gene sequence terminators, rho-independent *E. coli* terminators, and the lacZ alpha terminator.

t. Variant

"Variant" used herein to refer to a nucleic acid may mean (i) a portion of a referenced nucleotide sequence; (ii) the complement of a referenced nucleotide sequence or portion thereof; (iii) a nucleic acid that is substantially identical to a referenced nucleic acid or the complement thereof; or (iv) a nucleic acid that hybridizes under stringent conditions to the referenced nucleic acid, complement thereof, or a sequences substantially identical thereto.

u. Vector

"Vector" used herein may mean a nucleic acid sequence containing an origin of replication. A vector may be a plasmid, bacteriophage, bacterial artificial chromosome or yeast artificial chromosome. A vector may be a DNA or RNA vector. A vector may be either a self-replicating extrachromosomal vector or a vector which integrates into a host genome.

2. MicroRNA

While not being bound by theory, the current model for the maturation of mammalian miRNAs is shown in FIG. 1. A gene coding for a miRNA may be transcribed leading to production of an miRNA precursor known as the pri-miRNA. The pri-miRNA may be part of a polycistronic RNA comprising multiple pri-miRNAs. The pri-miRNA may form a hairpin with a stem and loop. As indicated on FIG. 1, the stem may comprise mismatched bases.

The hairpin structure of the pri-miRNA may be recognized by Drosha, which is an RNase III endonuclease. Drosha may recognize terminal loops in the pri-miRNA and cleave approximately two helical turns into the stem to produce a 60-70 nt precursor known as the pre-miRNA. Drosha may cleave the pri-miRNA with a staggered cut typical of RNase III endonucleases yielding a pre-miRNA stem loop with a 5' phosphate and ~2 nucleotide 3' overhang. Approximately one helical turn of the stem (~10 nucleotides) extending beyond the Drosha cleavage site may be essential for efficient processing. The pre-miRNA may then be actively transported from the nucleus to the cytoplasm by Ran-GTP and the export receptor Ex-portin-5.

The pre-miRNA may be recognized by Dicer, which is also an RNase III endonuclease. Dicer may recognize the double-stranded stem of the pre-miRNA. Dicer may also recognize the 5' phosphate and 3' overhang at the base of the stem loop. Dicer may cleave off the terminal loop two helical turns away from the base of the stem loop leaving an additional 5' phosphate and ~2 nucleotide 3' overhang. The resulting siRNA-like duplex, which may comprise mismatches, comprises the mature miRNA and a similar-sized fragment known as the miRNA*. The miRNA and miRNA* may be derived from opposing arms of the pri-miRNA and pre-miRNA. MiRNA* sequences may be found in libraries of cloned miRNAs but typically at lower frequency than the miRNAs.

Although initially present as a double-stranded species with miRNA*, the miRNA may eventually become incorporated as a single-stranded RNA into a ribonucleoprotein complex known as the RNA-induced silencing complex (RISC). Various proteins can form the RISC, which can lead to variability in specificity for miRNA/miRNA* duplexes, binding site of the target gene, activity of miRNA (repress or activate), and which strand of the miRNA/miRNA* duplex is loaded in to the RISC.

When the miRNA strand of the miRNA:miRNA* duplex is loaded into the RISC, the miRNA* may be removed and degraded. The strand of the miRNA:miRNA* duplex that is loaded into the RISC may be the strand whose 5' end is less tightly paired. In cases where both ends of the miRNA:miRNA* have roughly equivalent 5' pairing, both miRNA and miRNA* may have gene silencing activity.

The RISC may identify target nucleic acids based on high levels of complementarity between the miRNA and the mRNA, especially by nucleotides 2-8 of the miRNA. Only one case has been reported in animals where the interaction between the miRNA and its target was along the entire length of the miRNA. This was shown for mir-196 and Hox B8 and it was further shown that mir-196 mediates the cleavage of the Hox B8 mRNA (Yekta et al 2004, Science 304-594). Otherwise, such interactions are known only in plants (Bartel & Bartel 2003, Plant Physiol 132-709).

A number of studies have looked at the base-pairing requirement between miRNA and its mRNA target for achieving efficient inhibition of translation (reviewed by Bartel 2004, Cell 116-281). In mammalian cells, the first 8 nucleotides of the miRNA may be important (Doench & Sharp 2004 GenesDev 2004-504). However, other parts of the microRNA may also participate in miRNA binding. Moreover, sufficient base pairing at the 3' can compensate for insufficient pairing at the 5' (Brennecke et al, 2005 PLoS 3-e85). Computation studies, analyzing miRNA binding on whole genomes have suggested a specific role for bases 2-7 at the 5' of the miRNA in target binding but the role of the first nucleotide, found usually to be "A" was also recognized (Lewis et at 2005 Cell 120-15). Similarly, nucleotides 1-7 or 2-8 were used to identify and validate targets by Krek et al (2005, Nat Genet 37-495).

The target sites in the mRNA may be in the 5' UTR, the 3' UTR or in the coding region. Interestingly, multiple miRNAs may regulate the same mRNA target by recognizing the same or multiple sites. The presence of multiple miRNA binding sites in most genetically identified targets may indicate that the cooperative action of multiple RISCs provides the most efficient translational inhibition.

MiRNAs may direct the RISC to downregulate gene expression by either of two mechanisms: mRNA cleavage or translational repression. The miRNA may specify cleavage of the mRNA if the mRNA has a certain degree of complementarity to the miRNA. When a miRNA guides cleavage, the cut may be between the nucleotides pairing to residues 10 and 11 of the miRNA. Alternatively, the miRNA may repress translation if the miRNA does not have the requisite degree of complementarity to the miRNA. Translational repression may be more prevalent in animals since animals may have a lower degree of complementarity between the miRNA and binding site.

It should be noted that there may be variability in the 5' and 3' ends of any pair of miRNA and miRNA*. This variability may be due to variability in the enzymatic processing of Drosha and Dicer with respect to the site of cleavage. Variability at the 5' and 3' ends of miRNA and miRNA* may also be due to mismatches in the stem structures of the pri-miRNA and pre-miRNA. The mismatches of the stem strands may lead to a population of different hairpin structures. Variability in the stem structures may also lead to variability in the products of cleavage by Drosha and Dicer.

3. Nucleic Acid

Nucleic acids are provided herein. The nucleic acid may comprise the sequence of SEQ ID NOS: 1-3751 or variants thereof. The variant may be a complement of the referenced nucleotide sequence. The variant may also be a nucleotide sequence that is substantially identical to the referenced nucleotide sequence or the complement thereof. The variant may also be a nucleotide sequence that hybridizes under stringent conditions to the referenced nucleotide sequence, complements thereof, or nucleotide sequences substantially identical thereto.

The nucleic acid may have a length of from 10 to 250 nucleotides. The nucleic acid may have a length of at least 10, 11, 12, 13, 14, 15, 16, 17, 18, 19, 20, 21, 22, 23, 24, 25, 26, 27, 28, 29, 30, 35, 40, 45, 50, 60, 70, 80, 90, 100, 125, 150, 175, 200 or 250 nucleotides. The nucleic acid may be synthesized or expressed in a cell (in vitro or in vivo) using a synthetic gene described herein. The nucleic acid may be synthesized as a single strand molecule and hybridized to a substantially complementary nucleic acid to form a duplex. The nucleic acid may be introduced to a cell, tissue or organ in a single- or double-stranded form or capable of being expressed by a synthetic gene using methods well known to those skilled in the art, including as described in U.S. Pat. No. 6,506,559 which is incorporated by reference.

a. Pri-miRNA

The nucleic acid may comprise a sequence of a pri-miRNA or a variant thereof. The pri-miRNA sequence may comprise from 45-250, 55-200, 70-150 or 80-100 nucleotides. The sequence of the pri-miRNA may comprise a pre-miRNA, miRNA and miRNA*, as set forth herein, and variants thereof. The sequence of the pri-miRNA may comprise the sequence of SEQ ID NOS: 1-20, the complement of a target gene binding site referred to in Table 4, or variants thereof.

The pri-miRNA may form a hairpin structure. The hairpin may comprise a first and second nucleic acid sequence that are substantially complementary. The first and second nucleic acid sequence may be from 37-50 nucleotides. The first and second nucleic acid sequence may be separated by a third sequence of from 8-12 nucleotides. The hairpin structure may have a free energy less than −25 Kcal/mole as calculated by the Vienna algorithm with default parameters, as described in Hofacker et al., Monatshefte f. Chemie 125: 167-188 (1994), the contents of which are incorporated herein. The hairpin may comprise a terminal loop of 4-20, 8-12 or 10 nucleotides. The pri-miRNA may comprise at least 19% adenosine nucleotides, at least 16% cytosine nucleotides, at least 23% thymine nucleotides and at least 19% guanine nucleotides.

b. Pre-miRNA

The nucleic acid may also comprise a sequence of a pre-miRNA or a variant thereof. The pre-miRNA sequence may comprise from 45-90, 60-80 or 60-70 nucleotides. The sequence of the pre-miRNA may comprise a miRNA and a miRNA* as set forth herein, The sequence of the pre-miRNA may also be that of a pri-miRNA excluding from 0-160 nucleotides from the 5' and 3' ends of the pri-miRNA. The sequence of the pre-miRNA may comprise the sequence of SEQ ID NOS: 1-20, the complement of a target gene binding site referred to in Table 4, or variants thereof.

c. MiRNA

The nucleic acid may also comprise a sequence of a miRNA (including miRNA*) or a variant thereof. The miRNA sequence may comprise from 13-33, 18-24 or 21-23 nucleotides. The miRNA may also comprise a total of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 nucleotides. The sequence of the miRNA may be the first 13-33 nucleotides of the pre-miRNA. The sequence of the miRNA may also be the last 13-33 nucleotides of the pre-miRNA. The sequence of the miRNA may comprise the sequence of SEQ ID NOS: 11-20, the complement of a target gene binding site referred to in Table 4, or variants thereof.

d. Anti-miRNA

The nucleic acid may also comprise a sequence of an anti-miRNA that is capable of blocking the activity of a miRNA or miRNA*, such as by binding to the pri-miRNA, pre-miRNA, miRNA or miRNA* (e.g. antisense or RNA silencing), or by binding to the target binding site. The anti-miRNA may comprise a total of 5-100 or 10-60 nucleotides. The anti-miRNA may also comprise a total of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 nucleotides. The sequence of the anti-miRNA may comprise (a) at least 5 nucleotides that are substantially complementary to the 5' of a miRNA and at least 5-12 nucleotides that are substantially identical to the flanking regions of the target site from the 5' end of the miRNA, for the purposes of binding to a miRNA and repressing its activity; or (b) at least 5-12 nucleotides that are substantially identical to the 3' of a miRNA and at least 5 nucleotide that are substantially complementary to the flanking region of the target site from the 3' end of the miRNA, for the purposes of inhibiting the ability of a miRNA to bind to its target. The sequence of the anti-miRNA may comprise the complement of SEQ ID NOS: 11-20, the complement of a target gene binding site referred to in Table 4, or variants thereof.

e. Binding Site of Target

The nucleic acid may also comprise a sequence of a target miRNA binding site, or a variant thereof. The target site sequence may comprise a total of 5-100 or 10-60 nucleotides. The target site sequence may also comprise a total of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62 or 63 nucleotides. The target site sequence may comprise at least 5 nucleotides of the sequence of SEQ ID NOS: 21-3751, or a target gene binding site referred to in Table 4.

4. Synthetic Gene

A synthetic gene is also provided comprising a nucleic acid described herein operably linked to a transcriptional and/or translational regulatory sequence. The synthetic gene may be capable of modifying the expression of a target gene with a binding site for a nucleic acid described herein. Expression of the target gene may be modified in a cell, tissue or organ. The synthetic gene may be synthesized or derived from naturally-occurring genes by standard recombinant techniques. The synthetic gene may also comprise terminators at the 3'-end of the transcriptional unit of the synthetic gene sequence. The synthetic gene may also comprise a selectable marker.

5. Vector

A vector is also provided comprising a nucleic acid described herein, such as a pri-miRNA, pre-miRNA, miRNA, anti-miRNA, target gene binding site, or synthetic gene. The vector may be an expression vector. An expression vector may comprise additional elements. For example, the expression vector may have two replication systems allowing it to be maintained in two organisms, e.g., in one host cell for expression and in a second host cell (e.g., bacteria) for cloning and amplification. For integrating expression vectors, the expression vector may contain at least one sequence homologous to the host cell genome, and preferably two homologous sequences that flank the expression construct. The integrating vector may be directed to a specific locus in the host cell by selecting the appropriate homologous sequence for inclusion in the vector. The vector may also comprise a selectable marker gene to allow the selection of transformed host cells.

6. Host Cell

A host cell is also provided comprising a vector, synthetic gene or nucleic acid described herein. The cell may be a bacterial, fungal, plant, insect or animal cell.

7. Probes

A probe is also provided comprising a nucleic acid described herein. Probes may be used for screening and diagnostic methods, as outlined below. The probe may be attached or immobilized to a solid substrate, such as a biochip.

The probe may have a length of from 8 to 500, 10 to 100 or 20 to 60 nucleotides. The probe may also have a length of at least 8, 9, 10, 11, 12, 13, 14, 15, 16, 17, 18, 19, 20, 21, 22, 23, 24, 25, 26, 27, 28, 29, 30, 35, 40, 45, 50, 60, 70, 80, 90, 100, 120, 140, 160, 180, 200, 220, 240, 260, 280 or 300 nucleotides. The probe may further comprise a linker sequence of from 10-60 nucleotides.

8. Biochip

A biochip is also provided. The biochip may comprise a solid substrate comprising an attached probe or plurality of probes described herein. The probes may be capable of hybridizing to a target sequence under stringent hybridization conditions. The probes may be attached at spatially defined address on the substrate. More than one probe per target sequence may be used, with either overlapping probes or probes to different sections of a particular target sequence.

The probes may be capable of hybridizing to target sequences associated with a single disorder.

The probes may be attached to the biochip in a wide variety of ways, as will be appreciated by those in the art. The probes may either be synthesized first, with subsequent attachment to the biochip, or may be directly synthesized on the biochip.

The solid substrate may be a material that may be modified to contain discrete individual sites appropriate for the attachment or association of the probes and is amenable to at least one detection method. Representative examples of substrates include glass and modified or functionalized glass, plastics (including acrylics, polystyrene and copolymers of styrene and other materials, polypropylene, polyethylene, polybutylene, polyurethanes, TeflonJ, etc.), polysaccharides, nylon or nitrocellulose, resins, silica or silica-based materials including silicon and modified silicon, carbon, metals, inorganic glasses and plastics. The substrates may allow optical detection without appreciably fluorescing.

The substrate may be planar, although other configurations of substrates may be used as well. For example, probes may be placed on the inside surface of a tube, for flow-through sample analysis to minimize sample volume. Similarly, the substrate may be flexible, such as a flexible foam, including closed cell foams made of particular plastics.

The biochip and the probe may be derivatized with chemical functional groups for subsequent attachment of the two. For example, the biochip may be derivatized with a chemical functional group including, but not limited to, amino groups, carboxyl groups, oxo groups or thiol groups. Using these functional groups, the probes may be attached using functional groups on the probes either directly or indirectly using a linkers. The probes may be attached to the solid support by either the 5' terminus, 3' terminus, or via an internal nucleotide.

The probe may also be attached to the solid support non-covalently. For example, biotinylated oligonucleotides can be made, which may bind to surfaces covalently coated with streptavidin, resulting in attachment. Alternatively, probes may be synthesized on the surface using techniques such as photopolymerization and photolithography.

9. Expression Analysis

A method of identifying a nucleic acid associated with a disease or a pathological condition is also provided. The method comprises measuring a level of the nucleic acid in a sample that is different than the level of a control. Detection may be performed by contacting the sample with a probe or biochip described herein and detecting the amount of hybridization. PCR may be used to amplify nucleic acids in the sample, which may provide higher sensitivity.

The level of the nucleic acid in the sample may also be compared to a control cell (e.g., a normal cell) to determine whether the nucleic acid is differentially expressed (e.g., overexpressed or underexpressed). The ability to identify miRNAs that are differentially expressed in pathological cells compared to a control can provide high-resolution, high-sensitivity datasets which may be used in the areas of diagnostics, prognostics, therapeutics, drug development, pharmacogenetics, biosensor development, and other related areas. An expression profile generated by the current methods may be a "fingerprint" of the state of the sample with respect to a number of miRNAs. While two states may have any particular miRNA similarly expressed, the evaluation of a number of miRNAs simultaneously allows the generation of a gene expression profile that is characteristic of the state of the cell. That is, normal tissue may be distinguished from diseased tissue. By comparing expression profiles of tissue in known different disease states, information regarding which miRNAs are associated in each of these states may be obtained. Then, diagnosis may be performed or confirmed to determine whether a tissue sample has the expression profile of normal or disease tissue. This may provide for molecular diagnosis of related conditions.

The expression level of a disease-associated nucleic acid is information in a number of ways. For example, a differential expression of a disease-associated nucleic acid compared to a control may be used as a diagnostic that a patient suffers from the disease. Expression levels of a disease-associated nucleic acid may also be used to monitor the treatment and disease state of a patient. Furthermore, expression levels of a disease-associated miRNA may allow the screening of drug candidates for altering a particular expression profile or suppressing an expression profile associated with disease.

A target nucleic acid may be detected and levels of the target nucleic acid measured by contacting a sample comprising the target nucleic acid with a biochip comprising an attached probe sufficiently complementary to the target nucleic acid and detecting hybridization to the probe above control levels.

The target nucleic acid may also be detected by immobilizing the nucleic acid to be examined on a solid support such as nylon membranes and hybridizing a labeled probe with the sample. Similarly, the target nucleic may also be detected by immobilizing the labeled probe to a solid support and hybridizing a sample comprising a labeled target nucleic acid. Following washing to remove the non-specific hybridization, the label may be detected.

The target nucleic acid may also be detected in situ by contacting permeabilized cells or tissue samples with a labeled probe to allow hybridization with the target nucleic acid. Following washing to remove the non-specifically bound probe, the label may be detected.

These assays can be direct hybridization assays or can comprise sandwich assays, which include the use of multiple probes, as is generally outlined in U.S. Pat. Nos. 5,681,702; 5,597,909; 5,545,730; 5,594,117; 5,591,584; 5,571,670; 5,580,731; 5,571,670; 5,591,584; 5,624,802; 5,635,352; 5,594,118; 5,359,100; 5,124,246; and 5,681,697, each of which is hereby incorporated by reference.

A variety of hybridization conditions may be used, including high, moderate and low stringency conditions as outlined above. The assays may be performed under stringency conditions which allow hybridization of the probe only to the target. Stringency can be controlled by altering a step parameter that is a thermodynamic variable, including, but not limited to, temperature, formamide concentration, salt concentration, chaotropic salt concentration pH, or organic solvent concentration.

Hybridization reactions may be accomplished in a variety of ways. Components of the reaction may be added simultaneously, or sequentially, in different orders. In addition, the reaction may include a variety of other reagents. These include salts, buffers, neutral proteins, e.g., albumin, detergents, etc. which may be used to facilitate optimal hybridization and detection, and/or reduce non-specific or background interactions. Reagents that otherwise improve the efficiency of the assay, such as protease inhibitors, nuclease inhibitors and anti-microbial agents may also be used as appropriate, depending on the sample preparation methods and purity of the target.

a. Diagnostic

A method of diagnosis is also provided. The method comprises detecting a differential expression level of a disease-associated nucleic acid in a biological sample. The sample may be derived from a patient. Diagnosis of a disease state in a patient may allow for prognosis and selection of therapeutic strategy. Further, the developmental stage of cells may be classified by determining temporarily expressed disease-associated nucleic acids.

In situ hybridization of labeled probes to tissue arrays may be performed. When comparing the fingerprints between an individual and a standard, the skilled artisan can make a diagnosis, a prognosis, or a prediction based on the findings. It is further understood that the genes which indicate the diagnosis may differ from those which indicate the prognosis and molecular profiling of the condition of the cells may lead to distinctions between responsive or refractory conditions or may be predictive of outcomes.

b. Drug Screening

A method of screening therapeutics is also provided. The method comprises contacting a pathological cell capable of expressing a disease related nucleic acid with a candidate therapeutic and evaluating the effect of a drug candidate on the expression profile of the disease associated nucleic acid. Having identified the differentially expressed nucleic acid, a variety of assays may be executed. Test compounds may be screened for the ability to modulate gene expression of the disease associated nucleic acid. Modulation includes both an increase and a decrease in gene expression.

The test compound or drug candidate may be any molecule, e.g., protein, oligopeptide, small organic molecule, polysaccharide, polynucleotide, etc., to be tested for the capacity to directly or indirectly alter the disease phenotype or the expression of the disease associated nucleic acid. Drug candidates encompass numerous chemical classes, such as small organic molecules having a molecular weight of more than 100 and less than about 500, 1,000, 1,500, 2,000 or 2,500 daltons. Candidate compounds may comprise functional groups necessary for structural interaction with proteins, particularly hydrogen bonding, and typically include at least an amine, carbonyl, hydroxyl or carboxyl group, preferably at least two of the functional chemical groups. The candidate agents may comprise cyclical carbon or heterocyclic structures and/or aromatic or polyaromatic structures substituted with one or more of the above functional groups. Candidate agents are also found among biomolecules including peptides, saccharides, fatty acids, steroids, purines, pyrimidines, derivatives, structural analogs or combinations thereof.

Combinatorial libraries of potential modulators may be screened for the ability to bind to the disease associated nucleic acid or to modulate the activity thereof. The combinatorial library may be a collection of diverse chemical compounds generated by either chemical synthesis or biological synthesis by combining a number of chemical building blocks such as reagents. Preparation and screening of combinatorial chemical libraries is well known to those of skill in the art. Such combinatorial chemical libraries include, but are not limited to, peptide libraries encoded peptides, benzodiazepines, diversomers such as hydantoins, benzodiazepines and dipeptide, vinylogous polypeptides, analogous organic syntheses of small compound libraries, oligocarbamates, and/or peptidyl phosphonates, nucleic acid libraries, peptide nucleic acid libraries, antibody libraries, carbohydrate libraries, and small organic molecule libraries.

10. Gene Silencing

A method of reducing expression of a target gene in a cell, tissue or organ is also provided. Expression of the target gene may be reduced by expressing a nucleic acid described herein that comprises a sequence substantially complementary to one or more binding sites of the target mRNA. The nucleic acid may be a miRNA or a variant thereof. The nucleic acid may also be pri-miRNA, pre-miRNA, or a variant thereof, which may be processed to yield a miRNA. The expressed miRNA may hybridize to a substantially complementary binding site on the target mRNA, which may lead to activation of RISC-mediated gene silencing. An example for a study employing over-expression of miRNA is Yekta et al 2004, Science 304-594, which is incorporated herein by reference. One of ordinary skill in the art will recognize that the nucleic acids described herein may also be used to inhibit expression of target genes or inhibit activity of miRNAs using antisense methods well known in the art, as well as RNAi methods described in U.S. Pat. Nos. 6,506,559 and 6,573,099, which are incorporated by reference.

The target of gene silencing may be a protein that causes the silencing of a second protein. By repressing expression of the target gene, expression of the second protein may be increased. Examples for efficient suppression of miRNA expression are the studies by Esau et al 2004 JBC 275-52361; and Cheng et al 2005 Nucleic Acids Res. 33-1290, which is incorporated herein by reference.

11. Gene Enhancement

A method of increasing expression of a target gene in a cell, tissue or organ is also provided. Expression of the target gene may be increased by expressing a nucleic acid described herein that comprises a sequence substantially complementary to a pri-miRNA, pre-miRNA, miRNA or a variant thereof. The nucleic acid may be an anti-miRNA. The anti-miRNA may hybridize with a pri-miRNA, pre-miRNA or miRNA, thereby reducing its gene repression activity. Expression of the target gene may also be increased by expressing a nucleic acid that is substantially complementary to a portion of the binding site in the target gene, such that binding of the nucleic acid to the binding site may prevent miRNA binding.

12. Therapeutic

A method of modulating a disease or disorder associated with developmental dysfunctions is also provided. The disease or disorder may be cancer, such as prostate or liver cancer. In general, the nucleic acid molecules described herein may be used as a modulator of the expression of genes which are at least partially complementary to said nucleic acid. Further, miRNA molecules may act as target for therapeutic screening procedures, e.g. inhibition or activation of miRNA molecules might modulate a cellular differentiation process, e.g. proliferation or apoptosis.

Furthermore, existing miRNA molecules may be used as starting materials for the manufacture of sequence-modified miRNA molecules, in order to modify the target-specificity thereof, e.g. an oncogene, a multidrug-resistance gene or another therapeutic target gene. Further, miRNA molecules can be modified, in order that they are processed and then generated as double-stranded siRNAs which are again directed against therapeutically relevant targets. Furthermore, miRNA molecules may be used for tissue reprogramming procedures, e.g. a differentiated cell line might be transformed by expression of miRNA molecules into a different cell type or a stem cell.

13. Compositions

A pharmaceutical composition is also provided. The composition may comprise a nucleic acid described herein and optionally a pharmaceutically acceptable carrier. The compositions may be used for diagnostic or therapeutic applications. The pharmaceutical composition may be administered by known methods, including wherein a nucleic acid is introduced into a desired target cell in vitro or in vivo. Commonly used gene transfer techniques include calcium phosphate, DEAE-dextran, electroporation, microinjection, viral methods and cationic liposomes.

14. Kits

A kit is also provided comprising a nucleic acid described herein together with any or all of the following: assay reagents, buffers, probes and/or primers, and sterile saline or another pharmaceutically acceptable emulsion and suspension base. In addition, the kits may include instructional materials containing directions (e.g., protocols) for the practice of the methods described herein.

15. Method of Synthesis

A method of synthesizing the reverse-complement of a target nucleic acid is also provided. The reverse complement may be synthesized according to methods outlined in U.S. patent Ser. No. 11/384,049, the contents of which are incorporated herein by reference.

16. Method of Detection

A method of detecting a target nucleic acid in a biological sample is also provided. The target nucleic acid may be detected according to methods outlined in U.S. patent Ser. No. 11/384,049, the contents of which are incorporated herein by reference.

EXAMPLE 1

Prediction of MiRNAs

We surveyed the entire human genome for potential miRNA coding genes using computational approaches similar to those described in U.S. patent application Ser. Nos. 60/522,459, 10/709,577 and 10/709,572, the contents of which are incorporated herein by reference, for predicting miRNAs. Briefly, non-protein coding regions of the entire human genome were scanned for hairpin structures. The predicted hairpins and potential miRNAs were scored by thermodynamic stability, as well as structural and contextual features. The algorithm was calibrated by using miRNAs in the Sanger Database which had been validated.

Table 1 lists the SEQ ID NO for each predicted hairpin ("HID") from the computational screen. Table 1 also lists the genomic location for each hairpin ("Hairpin Location"). The format for the genomic location is a concatenation of <chr_id><strand><start position>. For example, 19+135460000 refers chromosome 19, +strand, start position 135460000. Chromosomes 23-25 refer to chromosome X, chromosome Y and mitochondrial DNA, respectively. The chromosomal location is based on the hg17 assembly of the human genome by UCSC (http://genome.ucsc.edu), which is based on NCBI Build 35 version 1 (35.1) and was produced by the International Human Genome Sequencing Consortium.

Table 1 also lists whether the hairpin is conserved in evolution ("C"). The hairpins were identified as conserved ("Y") or nonconserved ("N") by using phastCons data. The phastCons data is a measure of evolutionary conservation for each nucleotide in the human genome against the genomes of chimp, mouse, rat, dog, chicken, frog, and zebrafish, based on a phylo-HMM using best-in-genome pair wise alignment for each species based on BlastZ, followed by multiZ alignment of the 8 genomes (Siepel et al, J. Comput. Biol 11, 413-428, 2004 and Schwartz et al., Genome Res. 13, 103-107, 2003). A hairpin is listed as conserved if the average phastCons conservation score over the 7 species in any 15 nucleotide sequence within the hairpin stem is at least 0.9 (Berezikov, E. et al. Phylogenetic Shadowing and Computational Identification of Human microRNA Genes. Cell 120, 21-24, 2005).

Table 1 also lists the genomic type for each hairpin ("T") as either intergenic ("G"), intron ("I") or exon ("E"). Table 1 also lists the SEQ ID NO ("MID") for each predicted miRNA and miRNA*. Table 1 also lists the prediction score grade for each hairpin ("P") on a scale of 0-1 (1 the hairpin is the most reliable), as described in Hofacker et al., Monatshefte f. Chemie 125: 167-188, 1994. If the grade is zero or null, they are transformed to the lower value of PalGrade that its p-value is <0.05. Table 1 also lists the p-value ("Pval") calculated out of background hairpins for the values of each P scores. As shown in Table 1, there are few instances where the Pval is >0.05. In each of these cases, the hairpins are highly conserved or they have been validated (F=Y).

Table 1 also lists whether the miRNAs were validated by expression analysis ("E"); this column was intentionally left blank. Table 1 also lists whether the miRNAs were validated by sequencing ("S") (Y=Yes, N=No). If there was a difference in sequences between the predicted and sequenced miRNAs, the sequenced sequence is predicted. It should be noted that failure to sequence or detect expression of a miRNA does not necessarily mean that a miRNA does not exist. Such undetected miRNAs may be expressed in tissues other than those tested. In addition, such undetected miRNAs may be expressed in the test tissues, but at a difference stage or under different condition than those of the experimental cells.

Table 1 also lists whether the miRNAs were shown to be differentially expressed ("D") (Y=Yes, N=No) in at least one disease, as detailed in Table 2. Table 1 also lists whether the miRNAs were present ("F") (Y=Yes, N=No) in Sanger DB Release 8 (February 2005) (http://nar.oupjournals.org/) as being detected in humans or mice or predicted in humans. As discussed above, the miRNAs listed in the Sanger database are a component of the prediction algorithm and a control for the output.

Table 1 also lists a genetic location cluster ("LC") for those hairpins that are within 5,000 nucleotides of each other. Each miRNA that has the same LC share the same genetic cluster. Table 1 also lists a seed cluster ("SC") to group miRNAs by their seed of 2-7 by an exact match. Each miRNA that has the same SC have the same seed. For a discussion of seed lengths of 5-6 nucleotides being sufficient for miRNA activity, see Lewis et al., Cell, 120;15-20 (2005).

EXAMPLE 2

Prediction of Target Genes

The predicted miRNAs from the computational screen of Example 1 were then used to predict target genes and their binding sites using two computational approaches similar to those described in U.S. patent application Ser. Nos. 60/522, 459, 10/709,577 and 10/709,572, the contents of which are incorporated herein by reference, for predicting miRNAs.

Table 4 lists the predicted target gene for each miRNA (MID) and its hairpin (HID) from the computational screen. The names of the target genes were taken from NCBI Reference Sequence release 16 (http://www.ncbi.nlm.nih.gov; Pruitt et al., Nucleic Acids Res, 33(1):D501-D504, 2005; Pruitt et al., Trends Genet., 16(1):44-47, 2000; and Tatusova et al., Bioinformatics, 15(7-8):536-43, 1999). Target genes were identified by having a perfect complementary match of a 7 nucleotide miRNA seed (positions 2-8) that have an "A" after the seed on the UTR and/or an exact match in the nucleotide before the seed (total=8 nucleotides). For a discussion on identifying target genes, see Lewis et al., Cell, 120: 15-20, (2005). For a discussion of the seed being sufficient for binding of a miRNA to a UTR, see Lim Lau et al., (Nature 2005) and Brenneck et al, (PLoS Biol 2005).

Binding sites were then predicted using a filtered target genes dataset by including only those target genes that contained a UTR of a least 30 nucleotides. The binding site screen only considered the longest transcript when there were several transcripts per gene. A total of 16,656 transcripts were included in the dataset. Table 4 lists the SEQ ID NO for the predicted binding sites for each target gene as predicted from each miRNA ("MID"). The sequence of the binding site includes the 20 nucleotides 5' and 3' of the binding site. If the binding site encompasses 2 exons, the sequence includes 20 nucleotides 5' and 3' of the binding site, as the ends are situated on the spliced mRNA.

Table 5 shows the relationship between the miRNAs ("MID")/hairpins ("HID") and diseases by their target genes. The name of diseases are taken from OMIM. For a discussion of the rational for connecting the host gene the hairpin is located upon to disease, see Baskerville and Bartel, RNA, 11: 241-247 (2005) and Rodriguez et al., Genome Res., 14: 1902-1910 (2004). Table 5 shows the number of miRNA target genes ("N") that are related to the disease. Table 5 also shows the total number of genes that are related to the disease ("T"), which is taken from the genes that were predicted to have binding sites for miRNAs. Table 5 also shows the percentage of N out of T ("P") and the p-value of hypergeometric analysis ("Pval"). Table 8 shows the disease codes for the diseases described in Table 5 and Tables 9-11. For a reference of hypergeometric analysis, see Schaum's Outline of Elements of Statistics II: Inferential Statistics.

Table 9 shows the relationship between the target sequences ("Gene Name") and disease ("Disease Code").

Table 10 shows the relationship between the miRNAs ("MID")/hairpins ("HID"), known SNPs and diseases. SNP were identified in the sequence of hairpins. For the miRNAs of these hairpins, all their target genes listed in Table 4 were collected. For these genes, we checked whether they are associates to disease(s) according to OMIM. The numeric code of the relevant diseases for each miRNA according to Table 9 are presented in Table 10. The disease codes are taken from Table 8. If a target gene was not related to a disease in Table 9, SNP data is not presented. Each SNP ("SNP_Id") is identified based on NCBI database dbSNP BUILD 124 based on NCBI Human Genome Build 35.1. The genomic location for each SNP ("SNP_location") is also provided in a formation concatenating "<chr_id>:<start position>". For example, "19: 135460569" means chr19 +strand, start position 135460569. Although the mutations are referred to as SNPs, a number of the mutations cover a few nucleotides (e.g., small insertions, deletions, micro-satellites, etc.) For a discussion on the connection between a SNP and disease, see Swibertus (Blood 1996) and Frittitta (Diabetes 2001).

Table 11 shows the relationship between miRNAs ("MID"), hairpins ("HID"), SNP identification number ("SNP_Id"), SNP location ("SNP_location"), genes and diseases. SNP identification and location are defined as described for Table 10. The SNPs listed are only those that are located in a miRNA target gene known to be associated with a disease in the OMIM database. "Gene" indicates the name of the gene in which the SNP is located.

EXAMPLE 3

Differential Expression of miRNAs

1. Sequencing

To validate the hairpins ("HID"), a number of miRNAs were evaluated by sequencing methods similar to those described in U.S. patent application Ser. Nos. 60/522,459, 10/709,577 and 10/709,572, the contents of which are incorporated herein by reference. Table 3 shows the hairpins ("HID") that were validated by sequencing a miRNA ("MID") in the indicated tissue ("Tissue"). Numeric codes for the tissues are shown in Table 6.

2. Differential Expression

To confirm the hairpins and miRNAs predicted in Example 1, we detected expression in various tissues (versus controls) using the high-throughput microarrays similar to those described in U.S. patent application Ser. Nos. 60/522,459, 10/709,577 and 10/709,572, the contents of which are incorporated herein by reference. Microarray images were analyzed using Feature Extraction Software (Version 7.1.1, Agilent).

Differential expression of the miRNAs was then analyzed in various disease tissues using similar methods described above. Table 2 shows the ratio of disease related expression ("R") compared to normal tissues for the indicated diseases. Disease codes for the disease are shown in Table 7. Table 2 also shows the statistical analysis of the normalized signal ("RPval"). The signal of each probe was set as its median intensity. Signal intensities range from background level of 400 to saturating level of 66,000. 2 channels hybridization was performed and Cy3 signals were compared to Cy5 signals, where fluor reversed chip was preformed (normal vs. disease), probe signal was set to be its average signal. Signals were normalized by first performing a logarithmic transformation (log2), followed by adapting a polynomic graph of the second degree. Following normalization, a t-test for each miRNA and disease was performed. P values were estimated based on the occurrences of such or greater signal ratios over duplicated experiments. miRNAs with a p value <0.05 are shown in Table 2. The total number of samples ("N") used for each analysis is also shown in Table 2. The differential expression analysis in Table 2 indicates that the expression of a number of the miRNAs is significantly altered in disease tissue.

SEQUENCE LISTING (3751 sequences)

SEQ ID NO: 1 - RNA, 84 nt, Homo sapiens
gaggacuccaaggaacauucaacgcugucggugaguuugggauuugaaaaaaccacugaccguugacuguaccuugggguccuu

SEQ ID NO: 2 - RNA, 107 nt, Homo sapiens
agccuucgguacuugaagagugguuaucccugcuguguucgcuuaauuuaugacgaaucauacagggacauccaguuuuucaguaucaaauacugcuuuggaaggcu

SEQ ID NO: 3 - RNA, 86 nt, Homo sapiens
gggcgggggcccucgucuuacccagcaguguuugggugcgguugggagucucuaauacugccggguaaugauggaggccccugucc

SEQ ID NO: 4 - RNA, 84 nt, Homo sapiens
uugacuuagcuggguaguggggaacccuuccaugaggaguagaacacuccuuaugcaagauucccuucuaccuggcuggguugg

SEQ ID NO: 5 - RNA, 87 nt, Homo sapiens
gguugcuucagugaacauucaacgcugucggugaguuuggaauuaaaaucaaaaccaucgaccguugauuguacccuauggcuaacc

SEQ ID NO: 6 - RNA, 83 nt, Homo sapiens
ggccccgccaacccaguguucagacuaccuguucaggaggcucucaauguguacaguagucugcacauugguuaggcugggcu

SEQ ID NO: 7 - RNA, 84 nt, Homo sapiens
gccagucucuaggucccugagacccuuuaaccugugaggacauccagggucacaggugagguucuugggagccuggcgucuggc

SEQ ID NO: 8 - RNA, 79 nt, Homo sapiens
gcuccgucgccccaguguucagacuaccuguucaggacaaugccguuguacaguagucugcacauugguuagacugggc

SEQ ID NO: 9 - RNA, 99 nt, Homo sapiens
uucugugaccccuuagaggaugacugauuucuuuugguguucagagucaauauaauuuucuagcaccaucugaaaucgguuauaaugauuggggaagag

SEQ ID NO: 10 - RNA, 116 nt, Homo sapiens
cagcugcuggaagguguagguacccucaauggcucaguagccaguguagauccugucuuucguaaucagcagcuacaucuggcuacugggucucugauggcaucuucuagcuucug

SEQ ID NO: 11 - RNA, 23 nt, Homo sapiens
aacauucaacgcugucggugagu

SEQ ID NO: 12 - RNA, 22 nt, Homo sapiens
aaucauacagggacauccaguu

SEQ ID NO: 13 - RNA, 22 nt, Homo sapiens
uaauacugccggguaaugaugg

SEQ ID NO: 14 - RNA, 23 nt, Homo sapiens
aguggggaacccuuccaugagga

SEQ ID NO: 15 - RNA, 23 nt, Homo sapiens
aacauucaacgcugucggugagu

SEQ ID NO: 16 - RNA, 22 nt, Homo sapiens
uacaguagucugcacauugguu

SEQ ID NO: 17 - RNA, 23 nt, Homo sapiens
ucccugagacccuuuaaccugug

SEQ ID NO: 18 - RNA, 22 nt, Homo sapiens
uacaguagucugcacauugguu

SEQ ID NO: 19 - RNA, 21 nt, Homo sapiens
uagcaccaucugaaaucgguu

SEQ ID NO: 20 - RNA, 24 nt, Homo sapiens
agcuacaucuggcuacugggucuc

SEQ ID NO: 21 - RNA, 63 nt, Homo sapiens
aaaaaaaaaacaugcaccuguuucacugugaauagugaauguaaaggaaagaaaggaaaaacu

SEQ ID NO: 22 - RNA, 63 nt, Homo sapiens
aaaaaaaauaaauaaaagauauagaacaaaaaaaguccccacaccucuuucccauucagucgu

SEQ ID NO: 23 - RNA, 63 nt, Homo sapiens
aaaaaacacacauucagccaaccacuuauaugaauugaauguaucagaaguguacugaaggga

SEQ ID NO: 24 - RNA, 63 nt, Homo sapiens
aaaaacaugaacagucacauacuugagagaaacugugaauguaagguguaggaaaguacuuaa

SEQ ID NO: 25 - RNA, 63 nt, Homo sapiens
aaaaagaaaaaaaaagggaagaaaggaaacugaaucucagggaagugcccaccuccugagcua

SEQ ID NO: 26 - RNA, 61 nt, Homo sapiens
aaaaagagugaaaauauuuuaauuagcaguagauggugcuacuggcuuucauuugcugacu

SEQ ID NO: 27 - RNA, 63 nt, Homo sapiens
aaaaagcccagaaacccaggugcuggaccagggcccucagggaggggacccugcggcuagagu

SEQ ID NO: 28 - RNA, 64 nt, Homo sapiens
aaaaagugugucaagacaaccccuuucugcuuucuuauguagcaucugcaaagccgauucaugu

SEQ ID NO: 29 - RNA, 62 nt, Homo sapiens
aaaaauaguaugaaaauaaaauaaauguaugaaacaguauuaaugcagaaaugugcuacuaa

SEQ ID NO: 30 - RNA, 63 nt, Homo sapiens
aaaaauauaucugaaguuucuuguguuuuuuuuuuuccccacaaaguguguuuccacuuggag

SEQ ID NO: 31 - RNA, 62 nt, Homo sapiens
aaaaauauuuucucuaagauagaagaaguuauuucaguauuagcuauaggugcuaccuaccu

SEQ ID NO: 32 - RNA, 63 nt, Homo sapiens
aaaaauccuuuuauggaaaccauuuuuuuaaaaagugaauguacacaaauccacagaggacug

SEQ ID NO: 33 - RNA, 63 nt, Homo sapiens
aaaaauguagaaauucuucaugaacauaacucugcugaauguaaaagaaaauuuuuuuucaaa

SEQ ID NO: 34 - RNA, 64 nt, Homo sapiens
aaaacaaugugaauuuuuauaauaaaaugugaacugauguagcaaauuacgcaaaugugaagcc

SEQ ID NO: 35 - RNA, 62 nt, Homo sapiens
aaaacaccuaauuauuaaaacauuuauagagugccuacuguaugcaugaguugaguugcuuc

SEQ ID NO: 36 - RNA, 62 nt, Homo sapiens
aaaacaucugcugaauuccaaauuucuguaauagcuacuguaucugugauaaacuuuccuau

SEQ ID NO: 37 - RNA, 63 nt, Homo sapiens
aaaaccucaauuuaagucuuuaaaagguuguauuuugaauguaaccaaaaguuuacaguuuuu

SEQ ID NO: 38 - RNA, 63 nt, Homo sapiens
aaaacgugugucuggauauuaacucuuguuuaaacugaauguaugauauuuuguuagaaugga

SEQ ID NO: 39 - RNA, 63 nt, Homo sapiens
aaaacuuuauaaucgucauuguucaaccaagauuuugaauguaauaagaugaauauauuccuu

SEQ ID NO: 40 - RNA, 63 nt, Homo sapiens
aaaagaccagaaaugucauuucaaauguaaauuccugaauguaccauuaaaauuauuuuaguu

SEQ ID NO: 41 - RNA, 64 nt, Homo sapiens
aaaaggaaugauaaacuguauauaacuguaaaauauauguagcauauauacauggcuauaugcu

SEQ ID NO: 42 - RNA, 63 nt, Homo sapiens
aaaaggauggucacucuuccgaggucucccugaaaugaauguauuucucccccaaaagagcug

SEQ ID NO: 43 - RNA, 63 nt, Homo sapiens
aaaaggauuuacuauacuucacucuucuuuuuuuuuccccacaagcuuuuguagaugcauugu

SEQ ID NO: 44 - RNA, 64 nt, Homo sapiens
aaaaggauuuguauuaaaucuuauucuguauauuuaauguagcauuuuuguauuuaaauugaua

SEQ ID NO: 45 - RNA, 64 nt, Homo sapiens
aaaagucuucuucuggaaauacauauuacugcaaaaauguagcauccuuuuuuagguaggagua

SEQ ID NO: 46 - RNA, 62 nt, Homo sapiens
aaaagugacauauugucuauuacaugggcccaaucaguauuaaaguacuccccuuacucaaa

SEQ ID NO: 47 - RNA, 63 nt, Homo sapiens
aaaauauuagccacagaccaccuacaucacaauaacucagggagcuuauagaagugaagauuc

SEQ ID NO: 48 - RNA, 62 nt, Homo sapiens
aaaaucacaaaugcuauuucacccugcagguuagcaguauuaaaauagaaacaucaaauccc

SEQ ID NO: 49 - RNA, 63 nt, Homo sapiens
aaaaucaggcucaguuccccuacucuggccucuacuccccacaccccagugccacugugggug

SEQ ID NO: 50 - RNA, 62 nt, Homo sapiens
aaaaucaugaaauaucucacacuggagagaugcuguaugauauaaggaaugugggaaaguga

SEQ ID NO: 51 - RNA, 62 nt, Homo sapiens
aaaauccauaauauuuucugguaugaaaguuugacaguauuaauauuuuuuuuauauuuucu

SEQ ID NO: 52 - RNA, 63 nt, Homo sapiens
aaaaugaacugcccuucagcaucuaaugggaguugugaauguaacugguuaaugauacacauu

SEQ ID NO: 53 - RNA, 63 nt, Homo sapiens
aaaauuuaaaauaaaagcguuagaggcccuuuuuaugaauguaaccuaaguuucuguuugaca

SEQ ID NO: 54 - RNA, 63 nt, Homo sapiens
aaaauuuuauucuuagcacacuguuauguccuaacugaauguauucaguauucaaauaaaaga

SEQ ID NO: 55 - RNA, 64 nt, Homo sapiens
aaacaaaaacaaagggcaugaaaguaucugaaagcaauguagcacauaucuaucguaauauaug

SEQ ID NO: 56 - RNA, 62 nt, Homo sapiens
aaacaaaaaccccugcugcagcauuucaggugcaguaugauauuuccuaaucuuuccuauuu

SEQ ID NO: 57 - RNA, 63 nt, Homo sapiens
aaacaaggaccugaccccccgggcccauccccaggcucagggacucuggugccaaauccagaa

SEQ ID NO: 58 - RNA, 63 nt, Homo sapiens
aaacacaucagaaaucucacuggagagaaacuguaugaauguagagaaucugggaauaccuuu

SEQ ID NO: 59 - RNA, 63 nt, Homo sapiens
aaacacaugcggacacacaccggggagaagcccuaugaauguaaggacugugggaaagccuac

SEQ ID NO: 60 - RNA, 62 nt, Homo sapiens
aaacacguaguuccacuucguuuuuuucuucuugcuacuguaguuauuacaauaaauacugu

SEQ ID NO: 61 - RNA, 63 nt, Homo sapiens
aaacagaaaagaacaacagcaacaaaaacauugugugaauguauguuuguauguguguaugua

SEQ ID NO: 62 - RNA, 64 nt, Homo sapiens
aaacaguagcaaagaagucuauuuauuaacccacaaauguagcaucaagccagacucacaggua

SEQ ID NO: 63 - RNA, 61 nt, Homo sapiens
aaacaguauguaaaacucuguuuuuuaguauaauggugcuauuuuguaguuuguuauauga

SEQ ID NO: 64 - RNA, 63 nt, Homo sapiens
aaacauacuuugaagaaugaaacagauuguucccaugaauguaugcucauacucgacuagaaa

SEQ ID NO: 65 - RNA, 64 nt, Homo sapiens
aaacauaguguaucauuguguaaacucccaggcuugauguagcagaagagaucauuucuggagg

SEQ ID NO: 66 - RNA, 62 nt, Homo sapiens
aaacaucagaagcugcugccauaaugacuauuuucuacuguaggcugcuuuggaaauaauuc

SEQ ID NO: 67 - RNA, 63 nt, Homo sapiens
aaacaucagacaauucacacuggugacaaacccuaugaauguaaagauuguaaaaaagcuuuu

SEQ ID NO: 68 - RNA, 63 nt, Homo sapiens
aaacaucuuagaagauaggaaauauguuuaaaaaaugaauguauuaaaucuuaugaguaggaa

SEQ ID NO: 69 - RNA, 63 nt, Homo sapiens
aaacaugagaggaaucacacugcacagaaacacuaugaauguaaacugugugggaaaacuuac

SEQ ID NO: 70 - RNA, 63 nt, Homo sapiens
aaacaugggagaauccauacuagugagaaaccacgugaauguaaugaaugugggaacgcuuug

SEQ ID NO: 71 - RNA, 64 nt, Homo sapiens
aaacauguucaucuggaaguauuuuccuccaaaguaauguagcaugauuuuucaaggauuguua

SEQ ID NO: 72 - RNA, 62 nt, Homo sapiens
aaaccuauuaaaaaugauacuuagacagaauugucaguauuauucaagaacauuuaggcuau

SEQ ID NO: 73 - RNA, 62 nt, Homo sapiens
aaaccucaagacagauuuauuauucuuaaaugcuguaugauaaugaagaaaaauaaaaauuu

SEQ ID NO: 74 - RNA, 61 nt, Homo sapiens
aaacgcccuccgcucccucugcucccaacccuguggugcuaggaccacuccccgccuuccc

SEQ ID NO: 75 - RNA, 61 nt, Homo sapiens
aaacuaacaagaggcaguguuaaauauuuuaaauggugcuauagccaauguauuugaaugc

SEQ ID NO: 76 - RNA, 63 nt, Homo sapiens
aaacucgaucuaaaguuuagcauuuccaucugcgaugaauguaggccacaaaccacaguagua

SEQ ID NO: 77 - RNA, 63 nt, Homo sapiens
aaacugcaucacacuguagccacuuugccaccaccuccccacauguagccgcugaaaccccca

SEQ ID NO: 78 - RNA, 63 nt, Homo sapiens
aaacuuacacugguuugacaguggucaguuacauguccccacaguuccaaugugccuguucac

SEQ ID NO: 79 - RNA, 62 nt, Homo sapiens
aaagaaaggauuuguauuacucuccaaaucuacuguacugucagcuucacuccaccugagaa

SEQ ID NO: 80 - RNA, 62 nt, Homo sapiens
aaagaaauaggcauuauuuuauugcuguaauauuguaugauacuuuaacuguacaauaaugu

SEQ ID NO: 81 - RNA, 62 nt, Homo sapiens
aaagaagagaggugcacauaauuuaugcaggcaaguaugauacuuauuucauugguuuugug

SEQ ID NO: 82 - RNA, 62 nt, Homo sapiens
aaagaccuuucccucucccugccccuagaacaaccaguauuagaaggugccaccauuggugc

SEQ ID NO: 83 - RNA, 63 nt, Homo sapiens
aaagaucauuuuauuaucuuuaacuguaucuauuuugaauguaaauuuaaaaaaaguaauucu

SEQ ID NO: 84 - RNA, 62 nt, Homo sapiens
aaagcaaucaguuaaugucuuuagcacacuaaagcaguauuaaacacagguacaaguuggaa

SEQ ID NO: 85 - RNA, 63 nt, Homo sapiens
aaagcaaugugagucccagagcccgcuuuuguucuuccccacaauuccauuacuaagaaacac

SEQ ID NO: 86 - RNA, 63 nt, Homo sapiens
aaagcacuuuuuauuuucauuuucugucacagacacucagggauagcaguaccauuuuacuuc

SEQ ID NO: 87 - RNA, 62 nt, Homo sapiens
aaagcagaguuagauuuuugcacauuaaaaaauucaguauuaauuaaacauuacuuauucua

SEQ ID NO: 88 - RNA, 63 nt, Homo sapiens
aaagcaggaucucucaauguucaguguuuuguguuuccccacacgauuugucagagagaaaug

SEQ ID NO: 89 - RNA, 62 nt, Homo sapiens
aaagcaugacuaaacugcaaaaaaaaaaaaagagcuacuguauuuagacuuaggaaaaaagg

SEQ ID NO: 90 - RNA, 62 nt, Homo sapiens
aaaggaaaucgccuagcuccaggcuguguuaggacaguauuagcaugaaggcugugcgacca

SEQ ID NO: 91 - RNA, 63 nt, Homo sapiens
aaaggagaaaaggagaaaaggaccuuugaaagaugugaauguagagacaauugcagaccuuuu

SEQ ID NO: 92 - RNA, 62 nt, Homo sapiens
aaagggccagggcccugagggccuagcauuuuuucuacuguaaacguagcaagaucuguaua

SEQ ID NO: 93 - RNA, 62 nt, Homo sapiens
aaaggggggaaccagugaaaaugaaaggaaguuucaguauuagaugcacuuaaguuagccuc

SEQ ID NO: 94 - RNA, 62 nt, Homo sapiens
aaagguaugggauagaggggucagaugcagaucucuacuguaaaaugggcucccugguaucu

SEQ ID NO: 95 - RNA, 62 nt, Homo sapiens
aaaguaccuguguacuuaaaauauguguggagaccuacuguacaguaguuuugccccuuuaa

SEQ ID NO: 96 - RNA, 62 nt, Homo sapiens
aaaguagaucauacuuuuauguuccuuucuguuucuacuguagaugaauuuguaauugaaag

SEQ ID NO: 97 - RNA, 63 nt, Homo sapiens
aaagucugcuuaauuucaaaagaaaaaugccuaauugaauguaacucaucuugguguuauuau

SEQ ID NO: 98 - RNA, 63 nt, Homo sapiens
aaagugacuguauauuugaguucaccagcaauaacuccccacacucgaagcagguccaaaccc

SEQ ID NO: 99 - RNA, 63 nt, Homo sapiens
aaaguuuucucuauaggagauacucuccaguuuaaugaauguaauucuuguuaaauggaaaau

SEQ ID NO: 100 - RNA, 63 nt, Homo sapiens
aaaguuuuggcaguaaaauacucuguuuuuaaguaugaauguauuucauucauauuuccucuc

SEQ ID NO: 101 - RNA, 64 nt, Homo sapiens
aaauaaaagcaugcccucagcuuuuaaugaacuuaaauguagcacauauggcuuaaucucuuag

SEQ ID NO: 102 - RNA, 63 nt, Homo sapiens
aaauaaguaucuauguaaauuuguuuaaaauaaacugaauguauuuaaugguccauuuauaug

SEQ ID NO: 103 - RNA, 62 nt, Homo sapiens
aaauaauccuaauuauugccuuuucaauuauagucuacuguauuuauuuauaugggaucaac

SEQ ID NO: 104 - RNA, 63 nt, Homo sapiens
aaauaauuuuuaaucugcagacccacgaaaagggucucagggacuccuccaggggucuucaga

SEQ ID NO: 105 - RNA, 64 nt, Homo sapiens
aaauacauuaaauucaaagagaaaaaaaaucagcugauguagcaguauaucuuuuccuugaugg

SEQ ID NO: 106 - RNA, 63 nt, Homo sapiens
aaauaguuauguuggcacuguguucacacgcaugguccccacacccccagguuggguggguuu

SEQ ID NO: 107 - RNA, 62 nt, Homo sapiens
aaauaugucuuuaaguauuuuagacauuccucgucaguauuaggaauuuccaugggaaaaga

SEQ ID NO: 108 - RNA, 63 nt, Homo sapiens
aaauccccuggacuuucacuaacccucugacauacuccccacacccaguugauggcuuuccgu

SEQ ID NO: 109 - RNA, 61 nt, Homo sapiens
aaaucuggaaaagugcucauauucacagguggcuggugcuagucuaacuuaauucaugugu

SEQ ID NO: 110 - RNA, 63 nt, Homo sapiens
aaaucuguugucauguuaguaaaugauuugaaaacugaauguaauacuugaguagauuuuuuu

SEQ ID NO: 111 - RNA, 63 nt, Homo sapiens
aaaugaaauagcuaucaugaagcagaauacaaugaugaauguauagguugagugaauaaccaa

SEQ ID NO: 112 - RNA, 62 nt, Homo sapiens
aaaugaacccaguuuaagaauuugccaucaguagcaguauuaagcagugguuaaugucuuag

SEQ ID NO: 113 - RNA, 61 nt, Homo sapiens
aaaugagaaaucagugacaacaagucuuugaaauggugcuauggauuuaccauuccuuauu

SEQ ID NO: 114 - RNA, 64 nt, Homo sapiens
aaaugauacauuucucuuguuagguguuuucauaaaauguagcauuuuuuuucuuauggaaaua

SEQ ID NO: 115 - RNA, 64 nt, Homo sapiens
aaaugauguuuauagcagagcuucacuagacaugguauguagcauguagugcacaagcugauuu

SEQ ID NO: 116 - RNA, 62 nt, Homo sapiens
aaauggaauuuugcacauaauacauuguaauacuguaugauaaucaugugugaaaauaauuu

SEQ ID NO: 117 - RNA, 63 nt, Homo sapiens
aaauguaacuugaauguaaauaugcugcaaaauguugaauguauacauagaaagacuuuuucu

SEQ ID NO: 118 - RNA, 63 nt, Homo sapiens
aaauguguuauauggagacaugucuuguaaacaguugaauguauguaaguuuucuguuuguga

SEQ ID NO: 119 - RNA, 63 nt, Homo sapiens
aaauuaaugacaacucaugcuuuaauuuuguauuuugaauguacacgcaugcugaagcuaagu

SEQ ID NO: 120 - RNA, 62 nt, Homo sapiens
aaauuauagucuauuauuuuaaagggauuuuucaguaugauaugggccauuuuguucaucua

SEQ ID NO: 121 - RNA, 64 nt, Homo sapiens
aaauuauuaaaucggcaacagggcuucucuuuuuagauguagcacugagggcggccgggcgccc

SEQ ID NO: 122 - RNA, 61 nt, Homo sapiens
aaauuccccugacccagggccuggggaaucaucuggugcuacacuuuucgagcugcccugc

SEQ ID NO: 123 - RNA, 61 nt, Homo sapiens
aaauucuauuuauuaaugaaagugucacccuuuuggugcuaagcaggagaauucacaauua

SEQ ID NO: 124 - RNA, 63 nt, Homo sapiens
aaauugaccacuaggugacagaauguuugccaguauccccacaaaacaaguuaaaacuuaagu

SEQ ID NO: 125 - RNA, 63 nt, Homo sapiens
aaauuguccugcagagguucauuccccugacccuuuccccacauugguaagaguagcuggguu

SEQ ID NO: 126 - RNA, 63 nt, Homo sapiens
aaauuuaauguaguaacucacuuuuccauauauuuugaauguauauuucuauuuaugauacca

SEQ ID NO: 127 - RNA, 63 nt, Homo sapiens
aaauuuucacuguauuugagaugggaggguuaaggcucagggauuuuauuucagugaacugcu

SEQ ID NO: 128 - RNA, 62 nt, Homo sapiens
aacaaaagcuuuuugaauuguauaagauuuaugucuacuguaaacauugcuuaauuuuuuug

SEQ ID NO: 129 - RNA, 63 nt, Homo sapiens
aacaagacuuucccagcuuguauuaccuagaagcgugaauguauaggauaccugacuacuaag

SEQ ID NO: 130 - RNA, 63 nt, Homo sapiens
aacaauuacauaguuuuaagauaugaaucaaugugugaauguagaaagcuuaugauaaggccc

SEQ ID NO: 131 - RNA, 63 nt, Homo sapiens
aacaccagugaaauuuacacugcaaagaaaaacuaugaauguauggaauuuuuuaaaaagaag

SEQ ID NO: 132 - RNA, 64 nt, Homo sapiens
aacagaaaguaaggccuagauuuuaaaccugggcugauguagcagaccagcucgccgacacaca

SEQ ID NO: 133 - RNA, 63 nt, Homo sapiens
aacaggcaagccggcccccaccucucccugggggucucagggagaaccuuucacggcacccuu

SEQ ID NO: 134 - RNA, 62 nt, Homo sapiens
aacagucucucuuuauauaaauacacagaguuugguaugauauuuaaauacaucaucuggcc

SEQ ID NO: 135 - RNA, 62 nt, Homo sapiens
aacauaagacauacaucacauuauacacaaaaguguaugauauguacaacugagugguacag

SEQ ID NO: 136 - RNA, 63 nt, Homo sapiens
aacauaauuuauucuagguaaaauuuagauuguagugaauguaggaaguucuucagcacuuga

SEQ ID NO: 137 - RNA, 62 nt, Homo sapiens
aacauaccuaguuuuguguauuggcuuugcuggaguaugauagcaaaaugaagacucuuuua

SEQ ID NO: 138 - RNA, 63 nt, Homo sapiens
aacauaucauaacugcacugugaugaagaagcuguuccccacagaggagaagcucugcuuucu

SEQ ID NO: 139 - RNA, 62 nt, Homo sapiens
aacauauuuuugccaggaagaugaaaaucacauaguaugauaaacagguguauuccccucua

SEQ ID NO: 140 - RNA, 63 nt, Homo sapiens
aacaugauuuuauucuaugccaacauuugggccucugaauguaucuguuauuugaauuuaagu

SEQ ID NO: 141 - RNA, 62 nt, Homo sapiens
aacauguguuucucuuauggauuuuaauaagcuccaguauuauucaaaugaucaaaaauaua

SEQ ID NO: 142 - RNA, 64 nt, Homo sapiens
aacauugaaaaguuguggucugaucaguuaauuuguauguagcaguguaugcucucauauacaa

SEQ ID NO: 143 - RNA, 62 nt, Homo sapiens
aacauuuaucagaaauuuuaauacucugcauaaccaguauuagcauuagaaauuagccacuu

SEQ ID NO: 144 - RNA, 63 nt, Homo sapiens
aaccaaaacagaacaauuaaacagccaaauaaaaccucagggacaacauuuuugguguauuug

SEQ ID NO: 145 - RNA, 63 nt, Homo sapiens
aaccaaaggcacagauuuguguacaauauacccauugaauguauauccugagaaaaauugggg

SEQ ID NO: 146 - RNA, 63 nt, Homo sapiens
aaccaucuucaaggugcauggugggaauuaucaaccucagggauacucauuuuaacucaggcg

SEQ ID NO: 147 - RNA, 62 nt, Homo sapiens
aaccauugagaucagaaaccagauacuuagccuucuacuguagcuacggaaccagauucugg

SEQ ID NO: 148 - RNA, 63 nt, Homo sapiens
aaccauugagccaaugcauuggugucuccucaguucucagggaguguggguggcggcuccggc

SEQ ID NO: 149 - RNA, 63 nt, Homo sapiens
aaccauuggguucagcgaaaauggaaagauuuagcugaauguagucaguccaauuaaguugga

SEQ ID NO: 150 - RNA, 62 nt, Homo sapiens
aaccccccuuuguauuauagucaugcggucuuauguaugauaaacaguugaauaauuugucc

SEQ ID NO: 151 - RNA, 62 nt, Homo sapiens
aaccgcgcaguucauuggccacucugcacgcauucaguauuaccauggagcugggaaucuug

SEQ ID NO: 152 - RNA, 63 nt, Homo sapiens
aaccguggcucuugcccaauaccaaaucgccgcuuuccccacaagcccuucuuccuguaucaa

SEQ ID NO: 153 - RNA, 64 nt, Homo sapiens
aaccuccacaagugcugcaacagugcauuaguuuuuauguagcaauuuguuuauaaaaauuccc

SEQ ID NO: 154 - RNA, 63 nt, Homo sapiens
aaccucccccauuuaaauacucagaagauaaggugugaauguauguauuauuagaguccgaaa

SEQ ID NO: 155 - RNA, 63 nt, Homo sapiens
aaccuccuguaacuucuaucuguucuuuuuugaggcucagggagaaacuagcauuuuuuuuuu

SEQ ID NO: 156 - RNA, 63 nt, Homo sapiens
aaccucgccagcggggcccucuguggcacugggcacucagggagagcacguggcauuggagaa

SEQ ID NO: 157 - RNA, 62 nt, Homo sapiens
aaccuguaaaaguauugacucuucuaccaaguugguaugauauuccaggcagcucaaugauu

SEQ ID NO: 158 - RNA, 63 nt, Homo sapiens
aaccugugguaugaagccagaccuccccggcgggccucagggaacagaaugaucagaccuuug

SEQ ID NO: 159 - RNA, 62 nt, Homo sapiens
aacgucaauuagaaaauuaucugcgguuguuaaucuacuguauauuuuuguuugguauauuu

SEQ ID NO: 160 - RNA, 62 nt, Homo sapiens
aacgugcagaaauuuuggagggcugugauuuuuccaguauuaaacaugcaugcauuaaucuu

SEQ ID NO: 161 - RNA, 62 nt, Homo sapiens
aacuaggaaauuacuaaguauaaagaagaaaaaccaguauuaauuaagugaugagaccuguu

SEQ ID NO: 162 - RNA, 63 nt, Homo sapiens
aacuauaagaaaguaauaauuccauuuucuauccccucagggacugaacaaauggaaauaacu

SEQ ID NO: 163 - RNA, 63 nt, Homo sapiens
aacuauggggaaaaaaaaagaagaagaaaaagaaacucagggaucacugggagaagccauggc

SEQ ID NO: 164 - RNA, 63 nt, Homo sapiens
aacuauuaccuagagugaacuuuaagcuuuauuguugaauguaauuccauuauauuuccuuuu

SEQ ID NO: 165 - RNA, 62 nt, Homo sapiens
aacucaaccugcuuuuagaaggagaaacugccuacuacuguauaacaaaaaauaagaucaua

SEQ ID NO: 166 - RNA, 63 nt, Homo sapiens
aacuccugggcucaagugauucuccugcuuccaccuccccacagugcugggauuacaggcaug

SEQ ID NO: 167 - RNA, 63 nt, Homo sapiens
aacucuagcccugaagucacgccuuggcccugacauccccacaugcccgcagagauccucuuu

SEQ ID NO: 168 - RNA, 62 nt, Homo sapiens
aacucuuggcauuauacgucucccuuuuucuuuacaguauuaguaaaaagaaaaauuguaca

SEQ ID NO: 169 - RNA, 64 nt, Homo sapiens
aacugaaguucagauauauugaaacuuucuuaggacauguagcaaguaaacaguggagcccagg

SEQ ID NO: 170 - RNA, 63 nt, Homo sapiens
aacugcuuugugccugugugacucuggcauagcugcucagggagaauuacgugccucugugug

SEQ ID NO: 171 - RNA, 63 nt, Homo sapiens
aacuggauuugauuucuuuuuaugaaaguuucauaugaauguaacuugauuuuuuacuauuau

SEQ ID NO: 172 - RNA, 63 nt, Homo sapiens
aacuguauuucccaauacacuugagcaguugccugugaauguaagaggugucaacaaacuggg

SEQ ID NO: 173 - RNA, 62 nt, Homo sapiens
aacuguuuuccucauguucaguuauguuaaaguaguaugauaaaugcaugccuagaguagug

SEQ ID NO: 174 - RNA, 64 nt, Homo sapiens
aacuuuaaaaucgguuguauuuuacuuuaaauagagauguagcaauaucucguuugcuaauauu

SEQ ID NO: 175 - RNA, 64 nt, Homo sapiens
aagaaaauagagaauuuaauauauggugauugggauauguagcauucaaaaaaagugaauugcc

SEQ ID NO: 176 - RNA, 64 nt, Homo sapiens
aagaaguuuuuugggcgaaaaucuuggaucauuuuuauguagcaugauuuuccuugggaugcaa

SEQ ID NO: 177 - RNA, 62 nt, Homo sapiens
aagaaugaacuucugucugccucguggagccaagcuacuguacugagugcuuauucuuuugu

SEQ ID NO: 178 - RNA, 63 nt, Homo sapiens
aagacaucaugagaaaauaccagcaguaucuaucaugaauguagaaauaaaaguccuuaaaau

SEQ ID NO: 179 - RNA, 63 nt, Homo sapiens
aagacauccaaucaauaaugaaggaaauuuuuuucugaauguagguuugagugaggggcaccu

SEQ ID NO: 180 - RNA, 64 nt, Homo sapiens
aagacaucgugcagagauaaauggggauacaguuaaauguagcaacucuugaguucauuuuuuc

SEQ ID NO: 181 - RNA, 62 nt, Homo sapiens
aagacaugcauuuauauuuuguuucuguaauauucuacuguaggugaaaucuuuucaaaaau

SEQ ID NO: 182 - RNA, 62 nt, Homo sapiens
aagacgguuaauuacagcccgagaagaacguuaacaguauuaauucuaaccacaaaggagga

SEQ ID NO: 183 - RNA, 62 nt, Homo sapiens
aagauaaaauuacauaguauuaccuagacauagacaguauuaccuagguagaugcacugcuc

SEQ ID NO: 184 - RNA, 63 nt, Homo sapiens
aagauacuuguuuucuucuuuucaagaaaaguaucuccccacauaggcgguggacccaaaaag

SEQ ID NO: 185 - RNA, 62 nt, Homo sapiens
aagauccucuggaaaaagacuccgagaguuauaacuacuguaguauaaauauaggaacuaag

SEQ ID NO: 186 - RNA, 63 nt, Homo sapiens
aagauccuggagauauccugagagcacacagagcuuccccacaccuucagacuugcaccuugc

SEQ ID NO: 187 - RNA, 62 nt, Homo sapiens
aagauggaccugcucuuauacuguugauuacuuucaguauuaauauacuauuccccaauuau

SEQ ID NO: 188 - RNA, 62 nt, Homo sapiens
aagauguagucaccucagauaaaauugguaucguguaugauaauauuguaucauuuauauuu

SEQ ID NO: 189 - RNA, 63 nt, Homo sapiens
aagauguauauagauguauauaugcccaaauauauugaauguacagaaaggaaauauucagag

SEQ ID NO: 190 - RNA, 62 nt, Homo sapiens
aagauugagaagcugccaguggcugcaagagagccuacuguaacccucauggccacccccug

SEQ ID NO: 191 - RNA, 62 nt, Homo sapiens
aagauugcuuuuuuuuuuuuuuuaacuguaguuccaguauuauaugaugacuauugauuucc

SEQ ID NO: 192 - RNA, 62 nt, Homo sapiens
aagcacacuggauuaagggcagccacagugguuucuacuguauguaugaaccgaauggagga

SEQ ID NO: 193 - RNA, 63 nt, Homo sapiens
aagcacauggccuugggugacaaauuccucuuugaugaauguacccuguggggauguuucaua

SEQ ID NO: 194 - RNA, 63 nt, Homo sapiens
aagcacauucagauucacacuggaauaaaaccuuaugaauguaaggacugugggaaaacauuc

SEQ ID NO: 195 - RNA, 63 nt, Homo sapiens
aagcacucugaaaccaagaccuucccauuuccuccuccccacauggugcugaggcucccugcu

SEQ ID NO: 196 - RNA, 61 nt, Homo sapiens
aagcagugggguugggaccucagaugggaaggguggugcuaagauccuccugaccucaaag

SEQ ID NO: 197 - RNA, 62 nt, Homo sapiens
aagcauuauuuuucucgagucuuuuuuuguguugguaugauauauaaacgaaaucauauaca

SEQ ID NO: 198 - RNA, 63 nt, Homo sapiens
aagccucagagcagccaagucauugguguucauuuuccccacagugauuuuuguaacuucucu

SEQ ID NO: 199 - RNA, 64 nt, Homo sapiens
aagccucagcucauagugaacacagcagaccuagaaauguagcagcagccuacugaguagcuuu

SEQ ID NO: 200 - RNA, 61 nt, Homo sapiens
aagcuaagccagcucagagaacacggggagcgguggugcuacacggacuucggagcauaga

SEQ ID NO: 201 - RNA, 63 nt, Homo sapiens
aagcucagccugagagaaggagcuggcgagaaccuuccccacacucagcuccaaacgccuccu

SEQ ID NO: 202 - RNA, 63 nt, Homo sapiens
aagcugcuaauuguuccuguuggggugacagauacugaauguauacguauugugccugagcuc

SEQ ID NO: 203 - RNA, 61 nt, Homo sapiens
aagcuguugucaauuaucuaaagcauguuaguuuggugcuacacaguguugauuuuuguga

SEQ ID NO: 204 - RNA, 64 nt, Homo sapiens
aagcuuuauaagucgugaggauguuuuuauauuuaaauguagcaaacauacaugacaguucuug

SEQ ID NO: 205 - RNA, 61 nt, Homo sapiens
aaggagaugggccuggggugggggcuuaugaguuggugcuagagccagggccaucuggacu

SEQ ID NO: 206 - RNA, 63 nt, Homo sapiens
aaggagauuguugacccagugaccuggaguugaggcucagggagagaucugccacaugucuga

SEQ ID NO: 207 - RNA, 63 nt, Homo sapiens
aaggaucaauaaggaaugauuugaauguaauuuugugaauguguggaaaauauaaagcaggga

SEQ ID NO: 208 - RNA, 63 nt, Homo sapiens
aaggaugacucagcacugccgcucaacagacaugacucagggauggcuuaguacugccccuca

SEQ ID NO: 209 - RNA, 63 nt, Homo sapiens
aaggaugacucagcacugccgcucaacagggaugacucagggauggcuuaguacugccccuca

SEQ ID NO: 210 - RNA, 61 nt, Homo sapiens
aaggccaauaguuuuagauuauuuuaucugguauggugcuaauauuuuauuugaaaaaagu

SEQ ID NO: 211 - RNA, 63 nt, Homo sapiens
aaggccagaggaacagcuuugugcuccggcuuucccucagggaacagcagagagcaguuggcu

SEQ ID NO: 212 - RNA, 63 nt, Homo sapiens
aaggcucuucuccggggcacagugcuaguggggccuccccacaggccaccgucgcccagccug

SEQ ID NO: 213 - RNA, 64 nt, Homo sapiens
aagggaagcagccagacacgggggccuccuggugugauguagcaggaagugcagggcgccaccc

SEQ ID NO: 214 - RNA, 64 nt, Homo sapiens
aagggacaaguauguguugauuucagagaagcucagauguagcauuaggaccuucauccauacc

SEQ ID NO: 215 - RNA, 63 nt, Homo sapiens
aagggcagaggccacugcaccuguccucagacucauccccacacuugaccccauaggaacuga

SEQ ID NO: 216 - RNA, 63 nt, Homo sapiens
aagggccugcccaccaccgcccgccugggcagccaugaauguagcgccccaggcccugcccca

SEQ ID NO: 217 - RNA, 62 nt, Homo sapiens
aagggugcacaagagcuuacuucacccugaaaaucaguauuauuaaugaaaaguacuguuuu

SEQ ID NO: 218 - RNA, 62 nt, Homo sapiens
aagguaaccaucacuccuuaaauccacaugaaaacuacuguaacugaucauguauuuuggaa

SEQ ID NO: 219 - RNA, 63 nt, Homo sapiens
aagguaauauuuuuaauaugauacauuacauauugugaauguauacuaaaaaaacauuuuaaa

SEQ ID NO: 220 - RNA, 61 nt, Homo sapiens
aagguaggguauuaacauauuuugauaaauaaauggugcuagaguuggcgcagagguuuau

SEQ ID NO: 221 - RNA, 62 nt, Homo sapiens
aagguagguguuugauuagaacacauuuaaacaucaguauuaugaaaacuuguacuuuuugc

SEQ ID NO: 222 - RNA, 63 nt, Homo sapiens
aagguauuuacacauacaacuucauauaacugagaugaauguaauuuugaacuguuuaacacu

SEQ ID NO: 223 - RNA, 63 nt, Homo sapiens
aaggucagagcuuccaaaguaaacagcaagagaaccucagggagaguaagcucuagucccucu

SEQ ID NO: 224 - RNA, 63 nt, Homo sapiens
aaggucuaguuuuuuuuuacaguuaugacaaaccccucagggauuauucacauuuaaauauuu

SEQ ID NO: 225 - RNA, 63 nt, Homo sapiens
aaggucuccaugcagggggaggaggccugcuucuuuccccacagcucucacgucucccuucuc

SEQ ID NO: 226 - RNA, 63 nt, Homo sapiens
aagguuucaaaaaucauguaaggauuuaaacuugcugaauguaaagauugaaccucaagucac

SEQ ID NO: 227 - RNA, 62 nt, Homo sapiens
aaguaacccuaguaucagcaucaaguaugugguacuacuguaagagacaugaauggagacuu

SEQ ID NO: 228 - RNA, 61 nt, Homo sapiens
aaguaaucagaagcuaaaguaaaguuccuuuccuggugcuaacuguggucuucuugacaca

SEQ ID NO: 229 - RNA, 62 nt, Homo sapiens
aaguaaugguucucauagugguauaaaguucacacaguauuaugacacucccagcguaucau

SEQ ID NO: 230 - RNA, 62 nt, Homo sapiens
aaguacagugcaacauauacaaauugacugagugcaguauuagauuucaugggagcagccuc

SEQ ID NO: 231 - RNA, 62 nt, Homo sapiens
aagucauguauaagauguuuucuaaaagacuuuucaguauuacaacuaauacuauuauuauc

SEQ ID NO: 232 - RNA, 61 nt, Homo sapiens
aagucuccugauucggacaaccaugagggguaguggugcuagggagaaggcaaccuucacu

SEQ ID NO: 233 - RNA, 63 nt, Homo sapiens
aagucugaaguggaaagauguaagaaguuugaucuugaauguagacaauggaaggacagauuc

SEQ ID NO: 234 - RNA, 63 nt, Homo sapiens
aagucuuuucaacuucuguguuauagaacauucuaugaauguaguaauuaaucuauuuugcuc

SEQ ID NO: 235 - RNA, 63 nt, Homo sapiens
aagugaguuuaacaaagaaacauuuagaauagaucugaauguaagaacuacagaacuguuuca

SEQ ID NO: 236 - RNA, 62 nt, Homo sapiens
aagugcauggccuucuacggcuucuaugccaagcguaugauacuauagauauaguguaccau

SEQ ID NO: 237 - RNA, 62 nt, Homo sapiens
aagugcuuaaaaaguuaauaaaauaaaaugaucuguaugauaccugcaauugaaaagccgaa

SEQ ID NO: 238 - RNA, 63 nt, Homo sapiens
aagugugaacgugauguuuucggaugcaaacucagcucagggauucauuuugugucuuaguuu

SEQ ID NO: 239 - RNA, 63 nt, Homo sapiens
aaguguucauugcacaauauauuuuuacugcuuucugaauguagacggaacaguguggaagca

SEQ ID NO: 240 - RNA, 63 nt, Homo sapiens
aaguuaaaccucaucuuguacuaaaggaggacacacucagggagaagaccucugugggcaggg

SEQ ID NO: 241 - RNA, 62 nt, Homo sapiens
aaguuaccuuaauaguccucuuguguuauuaggacaguauuauuauaguacuuauuuauuuu

SEQ ID NO: 242 - RNA, 61 nt, Homo sapiens
aaguucuacauaauaaagguaaaacuuaaguaauggugcuacuucauuuuuuaaguauuuc

SEQ ID NO: 243 - RNA, 62 nt, Homo sapiens
aaguucugcuguaccuccaguggaugcuguuucucaguauuaugacaugugacaggugaacu

SEQ ID NO: 244 - RNA, 63 nt, Homo sapiens
aaguugcuaauaacggaaggggaucauagugguguugaauguaacuuugaaguagggaauggc

SEQ ID NO: 245 - RNA, 62 nt, Homo sapiens
aaguuugccaaccauaagugucaaaagcacaggccaguauuaagcagaaguucuaccaccuu

SEQ ID NO: 246 - RNA, 63 nt, Homo sapiens
aauaaaaaugcuuguauuucuuuaaaaaguaagccugaauguagaguaaaaggggaaaugcca

SEQ ID NO: 247 - RNA, 63 nt, Homo sapiens
aauaaagaaaugggugacaggcuuaaccucaccuaugaauguacaguauguggauuugugaaa

SEQ ID NO: 248 - RNA, 64 nt, Homo sapiens
aauaaagaccuccaaggguacuucuuuggaaaugaaauguagcacaaucuuagccuacguuacc

SEQ ID NO: 249 - RNA, 63 nt, Homo sapiens
aauaaaguguucuaugaaauucagaacuuuauuucugaauguaacaucccuaauaacaaccuu

SEQ ID NO: 250 - RNA, 63 nt, Homo sapiens
aauaauuuuuugucauuugucuuuauguccagcuaugaauguagauuuugugucccgacagcc

SEQ ID NO: 251 - RNA, 63 nt, Homo sapiens
aauacaaaacauaacccauuuaaugaugaauuacuugaauguauauuaucugugguuuaggaa

SEQ ID NO: 252 - RNA, 62 nt, Homo sapiens
aauacaaguggccaauagcacauaagaagaugcccaguauuacagccaagaggaaaaugcaa

SEQ ID NO: 253 - RNA, 61 nt, Homo sapiens
aauaccuaggaaauauuuuuccagucuacaauuuggugcuauugugcaguaacuaauagua

SEQ ID NO: 254 - RNA, 63 nt, Homo sapiens
aauaccuguauccaauuuguauuauucccccagcucucagggacaagaccagucccccagcgu

SEQ ID NO: 255 - RNA, 63 nt, Homo sapiens
aauagcauucgaagauccccagacuucauagaauacucagggaaagcauuuaaagggugaugu

SEQ ID NO: 256 - RNA, 62 nt, Homo sapiens
aauaggggguguaugugugaauuuuguuuaaacucuacuguauauugaaaugaaauucauuu

SEQ ID NO: 257 - RNA, 61 nt, Homo sapiens
aauaguguuaaaauuuaguuacaguuauucuuuuggugcuagcuuaacugucuucaucuaa

SEQ ID NO: 258 - RNA, 63 nt, Homo sapiens
aauauaugcaauuaaagaaguucauagauuucacaugaauguaaauguguuauauggagacau

SEQ ID NO: 259 - RNA, 62 nt, Homo sapiens
aauauauuuugaccuuaccauuauuccagagauucaguauuaaaaaaaaaaaaauuacacug

SEQ ID NO: 260 - RNA, 64 nt, Homo sapiens
aauaugcaacuccuuuucagagaucaggagggauuuauguagcagcuauuuuuacugcaaaagu

SEQ ID NO: 261 - RNA, 62 nt, Homo sapiens
aauauguaauucaccgaaaccacaccaaguccugcuacuguagaguggaaaugacuucugaa

SEQ ID NO: 262 - RNA, 63 nt, Homo sapiens
aauauugggggaaggagggcagacuccaucguuuccucagggagacugggcggaggugggguu

SEQ ID NO: 263 - RNA, 62 nt, Homo sapiens
aaucaaaaucacauuggguuauguaaucauuuaacaguauuaauuuuuccaaaacaucaaua

SEQ ID NO: 264 - RNA, 62 nt, Homo sapiens
aaucaauucauguuuaacguuucucauuaaaauccaguauuauauuaucauaucucucuuua

SEQ ID NO: 265 - RNA, 63 nt, Homo sapiens
aaucaauuucccaguuaugaugaguauuuacauuaugaauguauaacccagacaugauuugua

SEQ ID NO: 266 - RNA, 62 nt, Homo sapiens
aaucaguccugggaauagagaguguccuuugugccaguauuacaagaagcccaaacuuuauu

SEQ ID NO: 267 - RNA, 63 nt, Homo sapiens
aaucauguucuuauaccuaauuuuagucuuucaaaugaauguacuguaaugcuuguauguaua

SEQ ID NO: 268 - RNA, 62 nt, Homo sapiens
aaucauucuuacccaaguagguuuaugugagaagguaugauauuuauuacaaaauagccaaa

SEQ ID NO: 269 - RNA, 62 nt, Homo sapiens
aaucauuuuagacacuuuaggagggggugaaguuguaugauaaagcagauauuuuaauuauu

SEQ ID NO: 270 - RNA, 62 nt, Homo sapiens
aauccugugggaggaugagagcuacugggccguuguaugauagguugguaggggcuuguuga

SEQ ID NO: 271 - RNA, 63 nt, Homo sapiens
aaucuaguggggacguggagaacuuuugagucuaccucagggauuauagaugcaccaaucaac

SEQ ID NO: 272 - RNA, 63 nt, Homo sapiens
aaucuaguggggauguggagaaccuuugugucuagcucagggaucguaaacgcaccaaucagc

SEQ ID NO: 273 - RNA, 63 nt, Homo sapiens
aaucucccuucacaaguuuuuuuacuguuuuuagaugaauguacgaugagaaauucaacguua

SEQ ID NO: 274 - RNA, 62 nt, Homo sapiens
aaucuguagaauucuaaccuucuaacaccugugacaguauuaccacucuucuuguauuauag

SEQ ID NO: 275 - RNA, 62 nt, Homo sapiens
aaucuguguaauugggcccagauguggguuugcucaguauuaguagacaaggucuuuguuca

SEQ ID NO: 276 - RNA, 63 nt, Homo sapiens
aaucuuuuacaaacuccuacaggagagaagcuguaugaauguagaaaauuuagaaauugaggg

SEQ ID NO: 277 - RNA, 63 nt, Homo sapiens
aaugaaggguugugaguuuaguuucucuccuaaaaugaauguaugcccaccagagcagacauc

SEQ ID NO: 278 - RNA, 63 nt, Homo sapiens
aaugaaguagaggugacucucucugugguacacauugaauguacuauguauguucaaguauuc

SEQ ID NO: 279 - RNA, 62 nt, Homo sapiens
aaugagcaaguaaauagaauaauauuuuauuaauguaugauauguaauacuuauugucuaaa

SEQ ID NO: 280 - RNA, 62 nt, Homo sapiens
aaugagguggucacaugagaaaugauaccuguuacuacuguauuguuuuuagaguccugaag

SEQ ID NO: 281 - RNA, 61 nt, Homo sapiens
aaugaguguuuuuuuaagggaaugagaaugucauggugcuaaaccugacaaauaagagauc

SEQ ID NO: 282 - RNA, 63 nt, Homo sapiens
aaugauuuauuaauuaccaggauccuuuucuaaauugaauguacuuuugaauuacuagguuuc

SEQ ID NO: 283 - RNA, 61 nt, Homo sapiens
aaugcaaguaacuagccauuguucaaaugacaguggugcuauuucucuuuuguggccuuuu

SEQ ID NO: 284 - RNA, 62 nt, Homo sapiens
aaugcuuauguuuuuuaugaauuguuaaauauuucaguauuauauagaaaaaaauagauuuu

SEQ ID NO: 285 - RNA, 62 nt, Homo sapiens
aauggaaacucucuaguuuuuccauauaacuauccuacuguacauguuuaaacauauuuuau

SEQ ID NO: 286 - RNA, 62 nt, Homo sapiens
aaugggaugugcaugaacacggaggauccaugaacuacuguaaaguguugacagugugugca

SEQ ID NO: 287 - RNA, 62 nt, Homo sapiens
aaugggucagauugggaagccuaggaagagaguucuacuguagauuuccuaggcacugcucu

SEQ ID NO: 288 - RNA, 62 nt, Homo sapiens
aauguauauacauuuuagacaaaaaugcacacuccaguauuaauauuugugcuaccaucuac

SEQ ID NO: 289 - RNA, 64 nt, Homo sapiens
aauguauuauuaucacugucagaugagcaugcuugaauguagcaugacugccucuuuuugcuuu

SEQ ID NO: 290 - RNA, 63 nt, Homo sapiens
aaugucagguuauacuaaaacuaaaucagaaagucugaauguagcacauaaugguucucuucu

SEQ ID NO: 291 - RNA, 61 nt, Homo sapiens
aaugucauucaccugugacauuuuaagucucucuggugcuaagaauuggcacuuuauagcc

SEQ ID NO: 292 - RNA, 62 nt, Homo sapiens
aaugugaaagcauauuuuguauccuaaaaugaauguaugauauucuaaacaucuguuuuagu

SEQ ID NO: 293 - RNA, 63 nt, Homo sapiens
aauguggguggaccccguccagucuguugaaggccugaauguaacaaaagggcuuauucuucc

SEQ ID NO: 294 - RNA, 63 nt, Homo sapiens
aauguugacaggcaaauuucauacccaugucagauugaauguauuuaaauguauguauuuaag

SEQ ID NO: 295 - RNA, 61 nt, Homo sapiens
aauguugcagucaaaauuguggaaaaaaaaaaguggugcuaaaauuguucugaaaugaaga

SEQ ID NO: 296 - RNA, 63 nt, Homo sapiens
aauguuuuuuuguuccaacucuuuuucagauuuuuugaauguauauaggacuauguugaaaug

SEQ ID NO: 297 - RNA, 62 nt, Homo sapiens
aauuaaaaauauuuaaauccacaauuugauauaacaguauuauuuacauaagaacaaaguuu

SEQ ID NO: 298 - RNA, 63 nt, Homo sapiens
aauuacauccucccauggaggaugagagacugaggcucagggagggcaaggaauaggcccaag

SEQ ID NO: 299 - RNA, 62 nt, Homo sapiens
aauuacuguacaacuacuguauaaaauaaaacaacuacuguauaaaauaaacucucucuuuu

SEQ ID NO: 300 - RNA, 63 nt, Homo sapiens
aauuacuuuuaagugugcuuuaaagaaaaauauuuuccccacaagagaaauuuaaauaaagaa

SEQ ID NO: 301 - RNA, 62 nt, Homo sapiens
aauuagauaugcaucuggcauuguuuuaucuuaucaguauuaucacucuuauguugguuuau

SEQ ID NO: 302 - RNA, 62 nt, Homo sapiens
aauuaggaauuggaugcaucauuccuguguguuacaguauuauuuuaauuggccucaauggu

SEQ ID NO: 303 - RNA, 63 nt, Homo sapiens
aauuauaaaaaaguggauuuuuuuauuagaaacagugaauguaaaaaggaaguugauuucagu

SEQ ID NO: 304 - RNA, 61 nt, Homo sapiens
aauuauaaucaaaaucaaugcagguuuguuuuuuggugcuaauaugacauaugacaauaag

SEQ ID NO: 305 - RNA, 63 nt, Homo sapiens
aauuauaauuugagaaaaauauuacccaguaacauugaauguagauggcuaaacgauucuuac

SEQ ID NO: 306 - RNA, 62 nt, Homo sapiens
aauuauuucauaacuuuagcaguguguuuuggaacuacuguacuuaaagguuuguuuguuug

SEQ ID NO: 307 - RNA, 62 nt, Homo sapiens
aauucacaaauaacccuccauuuuucaauaucugcuacuguaaacaugaauauugaauacug

SEQ ID NO: 308 - RNA, 64 nt, Homo sapiens
aauucagcuuucuuuaacuuaauuguggucguguuaauguagcacaaaaaauauauuuuaauga

SEQ ID NO: 309 - RNA, 63 nt, Homo sapiens
aauucaucuuucagacaagcuuuagcagaaauggacucagggaagagacucacacgcuuuggu

SEQ ID NO: 310 - RNA, 63 nt, Homo sapiens
aauucaucuuucagacaaucuuuagcagaaauggacucagggaagagacucacaugcuuuggu

SEQ ID NO: 311 - RNA, 63 nt, Homo sapiens
aauucauuaauuuaguguaagaagaaaguuaagucugaauguaaauucaguguaagaugaaaa

SEQ ID NO: 312 - RNA, 61 nt, Homo sapiens
aauucauuucaaacucuaaaauuagauuaaugguggugcuaagaaagaguauuaauuacuu

SEQ ID NO: 313 - RNA, 64 nt, Homo sapiens
aauuccaauugcuuuuuggccuuuuggcuaaaauaaauguagcaucuaauuuuaucaguuuuua

SEQ ID NO: 314 - RNA, 63 nt, Homo sapiens
aauugaacugugccauuggcuauucaauagcuuauugaauguauguuuuggaugccacauccu

SEQ ID NO: 315 - RNA, 63 nt, Homo sapiens
aauugaaguuggguuggcucuuugugaaccucucauccccacagcagaaucaccaacacucuc

SEQ ID NO: 316 - RNA, 62 nt, Homo sapiens
aauugccuuuuuuuugugcuguacaaugucuacuguacugugggucauuuagaugagaugaa

SEQ ID NO: 317 - RNA, 62 nt, Homo sapiens
aauuggaaugcaaaaauuagcagacaauccauuccuacuguauuucuguaugaauguguuug

SEQ ID NO: 318 - RNA, 63 nt, Homo sapiens
aauuguacauaaaucccaaauguucuuaaagaacacucagggacauguuuguugccugggauu

SEQ ID NO: 319 - RNA, 62 nt, Homo sapiens
aauugucaguuauaugaauaaauuacaugucauucuacuguaacguugcccacgccgguuuu

SEQ ID NO: 320 - RNA, 64 nt, Homo sapiens
aauuguuuuguaauguaagacuaauuacuaauauuuauguagcaacuuuugugccagaaaaaag

SEQ ID NO: 321 - RNA, 64 nt, Homo sapiens
aauuuaauuuuuaaaauaggaaaaaaucccuguuugauguagcagacuuaauucuggaaaaguu

SEQ ID NO: 322 - RNA, 64 nt, Homo sapiens
aauuuauacuggagaaaaacuuugcaaguauaaugaauguagcagagccuuuaguuuuuguuca

SEQ ID NO: 323 - RNA, 62 nt, Homo sapiens
aauuuauguacucuauaacggugugaaugauuaccaguauuaagccauuuucucaucugaua

SEQ ID NO: 324 - RNA, 62 nt, Homo sapiens
aauuuauuuguaaaauccauaaaguacuucuguacaguauuagauucacaauugccauauau

SEQ ID NO: 325 - RNA, 63 nt, Homo sapiens
aauuucaaaccauuuaccaucugaaaguuuugauuugaauguaaaacaggaaauuggaauucc

SEQ ID NO: 326 - RNA, 62 nt, Homo sapiens
aauuucacauuguaaaaguuuuauuuuaucccuuguaugauauuacucaaaaaaucccugug

SEQ ID NO: 327 - RNA, 63 nt, Homo sapiens
aauuucuggcucauagaugguaccuucuugcuguguccccacaugguagaugggaagaacugg

SEQ ID NO: 328 - RNA, 62 nt, Homo sapiens
aauuugcuuuaacagauguugaaaacuaaauuuucuacuguauucccagcacgggugacuuc

SEQ ID NO: 329 - RNA, 63 nt, Homo sapiens
aauuuuuauuggauaaauaugaauaaauauuuucucucagggaaaauaauuuuugaaaguagg

SEQ ID NO: 330 - RNA, 62 nt, Homo sapiens
aauuuuugcugaugaaagugcuucauugacuaaacaguauuaguuuguggcuauaaaugauu

SEQ ID NO: 331 - RNA, 62 nt, Homo sapiens
acaaaacacugugcugucuaucccuuguacuugccuacuguaauauggauuucacuucugaa

SEQ ID NO: 332 - RNA, 63 nt, Homo sapiens
acaaaauggcguagaaugaaaugccucucacccuuuccccacagcgacuacuucccacucaga

SEQ ID NO: 333 - RNA, 64 nt, Homo sapiens
acaaaaugucaucaaagugacagauaaaauugucuuauguagcaaugugcauugaucucaauga

SEQ ID NO: 334 - RNA, 62 nt, Homo sapiens
acaaagaaucgcaaauucuucaaaugacuauuaucaguauuauuaacaugcgaugccacagg

SEQ ID NO: 335 - RNA, 62 nt, Homo sapiens
acaaaggaucuuucaugaauguccaaggguaagucaguauuaauuaaugcuguauuacaagg

SEQ ID NO: 336 - RNA, 64 nt, Homo sapiens
acaaaguaaaaugacuggcuuagcagauucuuugaaauguagcagcccagggauguaccaaaug

SEQ ID NO: 337 - RNA, 63 nt, Homo sapiens
acaaaguugagauucagcguuguugaacccccuuucucagggauggacacguuucacgagguc

SEQ ID NO: 338 - RNA, 63 nt, Homo sapiens
acaaaugagaacauaagauuuuuaaaauugcauugugaauguaaaauuuuuaucaauccuuug

SEQ ID NO: 339 - RNA, 62 nt, Homo sapiens
acaaauuuaaggggagcucuucaacauuaaggcaguaugauaucaugcuugguuuucuuuuu

SEQ ID NO: 340 - RNA, 63 nt, Homo sapiens
acaaccucuuuccccacagugcaauucagaauaugcucagggaaugccagccaccuuguaaaa

SEQ ID NO: 341 - RNA, 63 nt, Homo sapiens
acaagaagcagauccuggcccucccgcccccaccccucagggauauuuaaaacuuauuuuaua

SEQ ID NO: 342 - RNA, 61 nt, Homo sapiens
acaagagcucucugccuccggucacucuugcuguggugcuacguggaagugaauggagacu

SEQ ID NO: 343 - RNA, 62 nt, Homo sapiens
acaagugacgacagccauuccccuuugcagcuaucuacuguagugacagccauuucuugguu

SEQ ID NO: 344 - RNA, 62 nt, Homo sapiens
acaauauauuuaauucaaguccaauccauguaaucaguauuaagaguguguuuuaccauuca

SEQ ID NO: 345 - RNA, 63 nt, Homo sapiens
acaauguauuauuaucacugucagaugagcaugcuugaauguagcaugacugccucuuuuugc

SEQ ID NO: 346 - RNA, 63 nt, Homo sapiens
acaauguggaauuaccaaauuaaaagagaauacuaugaauguauucauauuuuuucuauauug

SEQ ID NO: 347 - RNA, 64 nt, Homo sapiens
acaauguuuacagguaccgaucccgaucccugcucaauguagcauuuuuuugguuuuauuuucu

SEQ ID NO: 348 - RNA, 62 nt, Homo sapiens
acaauuagauuucucacacucuaacuguauauuuguaugauauuuuaaaaucuccuaaaugc

SEQ ID NO: 349 - RNA, 62 nt, Homo sapiens
acaauucauuguuaaaaaacaaccaaaccucacacuacuguauuucauuaucuguacugaaa

SEQ ID NO: 350 - RNA, 63 nt, Homo sapiens
acaauuccaauagaagagaagacauaugaauguaaggaaugugggaaaaucuuggcuccuucc

SEQ ID NO: 351 - RNA, 62 nt, Homo sapiens
acacaccugauuuaaauugacaaacuuggaucuaguaugauaaacugauggcuauagacaaa

SEQ ID NO: 352 - RNA, 63 nt, Homo sapiens
acacaggcuuguuaaugucagucugugcugaggaccucagggacuugagguugcauuuuugag

SEQ ID NO: 353 - RNA, 63 nt, Homo sapiens
acacauacacacaugcgugcaggcuugugcagacacucagggauggagcugcugcugaaggga

SEQ ID NO: 354 - RNA, 63 nt, Homo sapiens
acaccaauuuggugaaaaugcugcuuuccucagccuccccacaauuaaacugcacauggucuc

SEQ ID NO: 355 - RNA, 63 nt, Homo sapiens
acaccccaaagagaagaaggggacucuggauaggguccccacauccagggcguggggagacca

SEQ ID NO: 356 - RNA, 63 nt, Homo sapiens
acacccuccuguguacccccccagggucaccgaaguccccacacgcuggcucuccacaccccu

SEQ ID NO: 357 - RNA, 63 nt, Homo sapiens
acacgcagcauuuuccugccguucucucagggacucucagggcagcuccugccacuccgccag

SEQ ID NO: 358 - RNA, 61 nt, Homo sapiens
acacggagacugacucuaaaacccuucauccaauggugcuaacccccggcucuccccugcc

SEQ ID NO: 359 - RNA, 63 nt, Homo sapiens
acacggugugaaaucacacauccagcugccccucccucagggagcgauccaggggaagccagu

SEQ ID NO: 360 - RNA, 63 nt, Homo sapiens
acacugggaggcccacuccuggcucaccucucccucucagggacccacgugggagccuggauc

SEQ ID NO: 361 - RNA, 63 nt, Homo sapiens
acacugucccugagugauccaggaggcugcccacauccccacaugugcacugugguuccagug

SEQ ID NO: 362 - RNA, 63 nt, Homo sapiens
acacuguucugauaucucugauugucauguggauuugaauguagcuugacagagagagaguuu

SEQ ID NO: 363 - RNA, 64 nt, Homo sapiens
acacuucaaaacccugguuauagauguacuguuuggauguagcauagucuugagucuagcgucc

SEQ ID NO: 364 - RNA, 62 nt, Homo sapiens
acagaaauguugcuggugaauuuauaagaaugugguaugauacuaguaaugaaggcaaaaug

SEQ ID NO: 365 - RNA, 63 nt, Homo sapiens
acagaagagcuucguguuagagaaacccgccugucuccccacauucucaguuuucuggagagc

SEQ ID NO: 366 - RNA, 63 nt, Homo sapiens
acagaguuuaaaugaauacauaaauguagaaguacugaauguauauauuuaaaaggagccucu

SEQ ID NO: 367 - RNA, 63 nt, Homo sapiens
acagaugcagaagguuucucuggauagcacaccucugaauguaaaucaugauaaaauggauau

SEQ ID NO: 368 - RNA, 63 nt, Homo sapiens
acagcacccccuuaggggugaugaggaagugggagcucagggaggaccccgggcagggcugcc

SEQ ID NO: 369 - RNA, 63 nt, Homo sapiens
acagcagcacgggccccacugugcugcucuucagguccccacagcccugccuuugguuccugg

SEQ ID NO: 370 - RNA, 61 nt, Homo sapiens
acagccggccacagggagaacuggugcuaaccagggugcuugcuuuggucacguucaacgc

SEQ ID NO: 371 - RNA, 61 nt, Homo sapiens
acagccugccauauuuuucacagcaugcaacaauggugcuaggauagcuauuucuuacugu

SEQ ID NO: 372 - RNA, 63 nt, Homo sapiens
acaggagccagcgggacgccgcacgcggccccagacucagggagcagggccaggcgggcucgg

SEQ ID NO: 373 - RNA, 62 nt, Homo sapiens
acaguaucuuacaaaaaacguguugcucucuucacaguauuauguguaaagucauuguuuaa

SEQ ID NO: 374 - RNA, 61 nt, Homo sapiens
acaguauguuacaugcauucuaccacuacauuuuggugcuauuuaaggugugcaauuuucu

SEQ ID NO: 375 - RNA, 61 nt, Homo sapiens
acagucaugucuuaauggaucccagcucugucauggugcuaucuauguauuaaguuggguc

SEQ ID NO: 376 - RNA, 63 nt, Homo sapiens
acauaaggagcgugggauccgauggaaagguggagcucagggaaaauggggguccuugccucu

SEQ ID NO: 377 - RNA, 64 nt, Homo sapiens
acauaaguauacucacacuaggauaaaacccuguacauguagcaaaugugggaaagacuacaga

SEQ ID NO: 378 - RNA, 62 nt, Homo sapiens
acauaauaugcagcuuaggaugcuauuuugagauguaugauauucaguucauucaccugauu

SEQ ID NO: 379 - RNA, 63 nt, Homo sapiens
acauagcuaggaaagcgaaugauaagggaaaaguucucagggaauugaaguguuguugcuaug

SEQ ID NO: 380 - RNA, 64 nt, Homo sapiens
acauauuuaaaacuguaucuguaagggcuuuucaaaauguagcaagauaaaaaucucuuauuca

SEQ ID NO: 381 - RNA, 62 nt, Homo sapiens
acauauuuaaacuaauauucccuuacaauauggacaguauuaauccuuccaagaugcaguau

SEQ ID NO: 382 - RNA, 62 nt, Homo sapiens
acauccaaguucaucauuuauucaacuuuucacacuacuguaguagacaauuuagauagaua

SEQ ID NO: 383 - RNA, 63 nt, Homo sapiens
acaucccacccccaucaauuacaguuuuuagagggcucagggauggugagagauccugaaaga

SEQ ID NO: 384 - RNA, 64 nt, Homo sapiens
acaucccccggagcagagaaggcgaccuuacaaagaauguagcaccgaccucaguaucugagac

SEQ ID NO: 385 - RNA, 63 nt, Homo sapiens
acaugcauaaaaauagaagacaaucugcuuguuucugaauguauggaaagacauuuugguuau

SEQ ID NO: 386 - RNA, 63 nt, Homo sapiens
acauguagaguuuguucagcuauuuuccagauaucuccccacaaaaggaggcaaaggguacca

SEQ ID NO: 387 - RNA, 63 nt, Homo sapiens
acaugucacuuuucuguuaagaaaacugagcccccuccccacagguuaaaaaacuuuaguaac

SEQ ID NO: 388 - RNA, 62 nt, Homo sapiens
acauuaaguauuuauugagcuucugucauaugcccaguauuaugcuucuucuauacuguuuc

SEQ ID NO: 389 - RNA, 62 nt, Homo sapiens
acauuauguggagcccuaucuuuacaaaaguuuccuacuguaaagugcuuuuauuuucaguu

SEQ ID NO: 390 - RNA, 62 nt, Homo sapiens
acauucaccucuuauuuuauauugaaauguauuacaguauuaaaacucaguguucaguauuu

SEQ ID NO: 391 - RNA, 63 nt, Homo sapiens
acauugacauucauuccuauuuuacugggcaccuaugaauguaugcugugugcuagaaauaga

SEQ ID NO: 392 - RNA, 58 nt, Homo sapiens
acauuuaaaaacacacugaaagaaaaacucugaauguaaggaauguggaaaucuuuua

SEQ ID NO: 393 - RNA, 64 nt, Homo sapiens
acauuuaaagucuuguuaauggugcuuuaagugucaauguagcauguaaaaggcuuuguacaga

SEQ ID NO: 394 - RNA, 62 nt, Homo sapiens
acauuuugccaaaauuauuaauauaagaagcuuucaguauuagugaugucaucugucacuau

SEQ ID NO: 395 - RNA, 63 nt, Homo sapiens
acauuuugcguuuuaauauuucucuuaacccuauucucagggaagauggaauuuaguuuuaag

SEQ ID NO: 396 - RNA, 63 nt, Homo sapiens
accaaaaaaacaaaugggacccuuuggauucuaugcucagggaagagcaggcagagccuugga

SEQ ID NO: 397 - RNA, 64 nt, Homo sapiens
accaaauuguugcaucugguucugaaaaaguauagcauguagcagcuuccaaacauauucauau

SEQ ID NO: 398 - RNA, 63 nt, Homo sapiens
accaauguuccaaauccuuuagggagaugaggguauccccacagaaaaagaggaauaauagac

SEQ ID NO: 399 - RNA, 63 nt, Homo sapiens
accaauguuugaugggaaaacguggcacucauaguugaauguauacuucuguaccaaaacuug

SEQ ID NO: 400 - RNA, 63 nt, Homo sapiens
accaauuuaugggagaauugcacacagaugugaaaugaauguaaucuaauagaagcccugggg

SEQ ID NO: 401 - RNA, 62 nt, Homo sapiens
accacagaaagggaaacuuuggaugaggggggcacuacuguacuuaggaauacaacuauaua

SEQ ID NO: 402 - RNA, 63 nt, Homo sapiens
accacggcagagagcagcgccgaugugaagaugaaugaauguaacuccuggugugaagaugaa

SEQ ID NO: 403 - RNA, 62 nt, Homo sapiens
accagaaagaaaggauuuguauuacucuccaaaucuacuguacugucagcuucacuccaccu

SEQ ID NO: 404 - RNA, 63 nt, Homo sapiens
accagcagaagccagcagagaggcaugggacagguuccccacaagccuuagaaggaagcaugg

SEQ ID NO: 405 - RNA, 63 nt, Homo sapiens
accagcuaauaguuucuuaaucucagauuucgagaugaauguaaacuguauucuuuugaaaug

SEQ ID NO: 406 - RNA, 63 nt, Homo sapiens
accaggacaugagagacauagaaaaacagaagucaugaauguaaauugaaugagaggcuuaac

SEQ ID NO: 407 - RNA, 62 nt, Homo sapiens
accaguuucacacccccuuuccaucuguuugauacaguauuauagauauaaauauauauaua

SEQ ID NO: 408 - RNA, 63 nt, Homo sapiens
accauaccuuagagacuuugauacuaccagggucucucagggauggagggaagaccugaaaga

SEQ ID NO: 409 - RNA, 62 nt, Homo sapiens
accauuuaugcuaauguuaaucuuucuguuuacaguaugauaauaaaacagugguccugaaa

SEQ ID NO: 410 - RNA, 61 nt, Homo sapiens
acccaauucaucaacuggaaagcaauucuaugcuggugcuaugcaauuaugcucuguguuu

SEQ ID NO: 411 - RNA, 62 nt, Homo sapiens
acccagaagccaguuuaggcuagagaggaaaaaacuacuguaucauuuauccuaaagaacag

SEQ ID NO: 412 - RNA, 63 nt, Homo sapiens
acccagccccacauccacauucuguuagaauguagcucagggagcuucguggacggccuugcu

SEQ ID NO: 413 - RNA, 63 nt, Homo sapiens
acccagcgguguacauggcagacccaguugguggucucagggagggaaaauuccuaucugggg

SEQ ID NO: 414 - RNA, 63 nt, Homo sapiens
acccaggauccugaaauucuccuggccgcaagaacuccccacagaggcagaagagggucucca

SEQ ID NO: 415 - RNA, 63 nt, Homo sapiens
acccauuugugcccagaccacaauauuucuucuuccucagggacuacaugccacagaccugua

SEQ ID NO: 416 - RNA, 61 nt, Homo sapiens
accccaugaucaagaauccugcuccacuaagaauggugcuaaaguaaaacuaguuuaauaa

SEQ ID NO: 417 - RNA, 63 nt, Homo sapiens
acccccgucuuauuaaggagcuuuuaaaguuuuucugaauguauagacauuucucggguuccu

SEQ ID NO: 418 - RNA, 63 nt, Homo sapiens
accccuguccccuggagaccagaagcugaggcccucucagggaggagacauccaagcaaauca

SEQ ID NO: 419 - RNA, 63 nt, Homo sapiens
acccguccauaccagcucccugcccaugacccucgcucagggaucccccuuugagggguuagg

SEQ ID NO: 420 - RNA, 63 nt, Homo sapiens
acccucauuuuuaggaaucuagugaugccucuugccucagggaaacguuucuuugauggggag

SEQ ID NO: 421 - RNA, 64 nt, Homo sapiens
acccuccccacaagcaaagcacaaauuuugggguccauguagcaugggccacguaggaggcucc

SEQ ID NO: 422 - RNA, 62 nt, Homo sapiens
acccugcccacucccaucccuucaaccccacuuccuacuguaauagaucagcauccaaaagc

SEQ ID NO: 423 - RNA, 63 nt, Homo sapiens
acccugcuacaguccuuaucaacacagcauucauucucagggaauugaaagcuccaagucacc

SEQ ID NO: 424 - RNA, 63 nt, Homo sapiens
acccuggcccucucggggcagagccgccaguguuucucagggaugugacugaggcccaggagg

SEQ ID NO: 425 - RNA, 62 nt, Homo sapiens
acccuuaugagaagugaagguuuuguaaacuuuccaguauuaauuugggcggguauuccccg

SEQ ID NO: 426 - RNA, 62 nt, Homo sapiens
acccuugcucuccaauuaggcccacguggcauuucaguauuauuaagucagggaaggagccc

SEQ ID NO: 427 - RNA, 62 nt, Homo sapiens
acccuuuuucauuauuucauuugcucucauauaucaguauuauuuuugagcauuuuguuaca

SEQ ID NO: 428 - RNA, 62 nt, Homo sapiens
accgaggacagauucaaauaacaauuaauggauucaguauuagcaauggacuggcaacuacu

SEQ ID NO: 429 - RNA, 63 nt, Homo sapiens
accguccuccgugacacacggcccccuuccuccuguccccacacucccaggagaaacucccgg

SEQ ID NO: 430 - RNA, 63 nt, Homo sapiens
accuaaaauaucaucuugaauuguaaucccuauaauccccacaucaagggagagaucaggugg

SEQ ID NO: 431 - RNA, 64 nt, Homo sapiens
accuaaguauacucacacuaggaaaaaucuguguacauguagcaaaugugggaaagacuauagg

SEQ ID NO: 432 - RNA, 63 nt, Homo sapiens
accuacagguuguguacuuuucauaaugguuuccaugaauguaguacguucauacaggcuuca

SEQ ID NO: 433 - RNA, 62 nt, Homo sapiens
accucauucaguuuuuauaauguauuuuugcaaacuacuguaaauagcaaaucaaugccaau

SEQ ID NO: 434 - RNA, 62 nt, Homo sapiens
accucucucuauucuacugucccuccagcacccucuacuguaaacacuuagcauugugccac

SEQ ID NO: 435 - RNA, 63 nt, Homo sapiens
accucugucucuuccuaaccuacaaaagcccuuucuccccacaagccucuggguuuucccuuu

SEQ ID NO: 436 - RNA, 63 nt, Homo sapiens
accucuuaucugggcagucaugugcugaguuaaaacucagggauucugugacuacaagaugaa

SEQ ID NO: 437 - RNA, 61 nt, Homo sapiens
accugaguuugugcuguaaggacaaaaugcugacuacuguagaaaaaaaggucaugauuca

SEQ ID NO: 438 - RNA, 62 nt, Homo sapiens
accugaugccagauuuuuuucauaaauauucugccuacuguaaauauggguuccucugaguu

SEQ ID NO: 439 - RNA, 63 nt, Homo sapiens
accuggucaaauuuauuuccuaucaaucacugaaucucagggauaaugggucaacccagaacu

SEQ ID NO: 440 - RNA, 63 nt, Homo sapiens
accugugaaauacugacaaugucuucuaccuuccuuccccacacccuguccuuauuagacacc

SEQ ID NO: 441 - RNA, 62 nt, Homo sapiens
accuuagguuuauuaaaggcuagguuuauuugggcaguauuagaaacaaaaucauggaucaa

SEQ ID NO: 442 - RNA, 63 nt, Homo sapiens
accuucacuuaccucagcuaucuuguuauccuacccucagggaguuguugagaggauucagug

SEQ ID NO: 443 - RNA, 63 nt, Homo sapiens
accuugauauacacagagauggucuuggagaauugugaauguauguacuguauugucaucaag

SEQ ID NO: 444 - RNA, 62 nt, Homo sapiens
accuuugcaaacauuggcaaauagcaucaauuaccuacuguauuuguuucuuuguuuauauu

SEQ ID NO: 445 - RNA, 62 nt, Homo sapiens
accuuugucacccugaaauauauauuuuaaacagcuacuguaaguaugaaaugaaagaaaaa

SEQ ID NO: 446 - RNA, 61 nt, Homo sapiens
accuuuucagaaucauggcagaggggcguggcguggugcuacugagaagguccuccuuccu

SEQ ID NO: 447 - RNA, 63 nt, Homo sapiens
acgauacguuuaaauguuguucuaguaaauauucuugaauguauuaaaauggcugaaaccaug

SEQ ID NO: 448 - RNA, 62 nt, Homo sapiens
acgauacuaaaaaaaaauagcuuuggaaaaaaaacuacuguauguaacggaauugcagaaua

SEQ ID NO: 449 - RNA, 62 nt, Homo sapiens
acgcaacaaacgguacauuuaaaaaggauggauucuacuguagguaaaauaugccucaguuu

SEQ ID NO: 450 - RNA, 63 nt, Homo sapiens
acgcauccauccuuggguccacugguccccauucuuccccacagacuuccuuugcuucucuuu

SEQ ID NO: 451 - RNA, 62 nt, Homo sapiens
acggaauuccuguccagaucuguuuauucuuuuacaguauuaaaugauuuucacuaauauau

SEQ ID NO: 452 - RNA, 62 nt, Homo sapiens
acguaucccugugcuggcaccugcucccugugcucaguauuaauuacgcccccuuaacuguc

SEQ ID NO: 453 - RNA, 63 nt, Homo sapiens
acguaugugcucuuauaaaguggacuucugaaaaaugaauguaaaagacacugguguaucuca

SEQ ID NO: 454 - RNA, 62 nt, Homo sapiens
acgucuccuccauagccccgggaccguguugcuccaguauuaaccucuguggguggccugca

SEQ ID NO: 455 - RNA, 62 nt, Homo sapiens
acgugcugcagcccuccugucccuuccccccagucaguauuacccugugaagccccuucccu

SEQ ID NO: 456 - RNA, 63 nt, Homo sapiens
acguuauuaaaaaauuacaaaugauagaaucuuuacucagggaugggcaauaaaacagcaaag

SEQ ID NO: 457 - RNA, 63 nt, Homo sapiens
acguuucuuguguugcccugaaaaaucuuugagaccucagggaggcucugucucucuuaaaag

SEQ ID NO: 458 - RNA, 62 nt, Homo sapiens
acguuuuuguuuuuuuaauguuaaauguguaacucaguauuacugaaaagguacccacauuu

SEQ ID NO: 459 - RNA, 62 nt, Homo sapiens
acuaaaacuggacagucuccugagacaagaccuccuacuguacucuuucuggggaagcagaa

SEQ ID NO: 460 - RNA, 63 nt, Homo sapiens
acuaaguugaauuauuuccaaaaugaaacaggcuucucagggacauauccacuucuucccagu

SEQ ID NO: 461 - RNA, 63 nt, Homo sapiens
acuacucuaaugcauuugguauguaacuuuaaauuugaauguauucuuguaaaacauccagua

SEQ ID NO: 462 - RNA, 62 nt, Homo sapiens
acuagauaaagucgauauugugagaggaauugcuguaugauaccguuuggagaaaugauuga

SEQ ID NO: 463 - RNA, 63 nt, Homo sapiens
acuagcuuguuuugacagguuuauuucacauccuaugaauguauguaaauaaacuguacauag

SEQ ID NO: 464 - RNA, 63 nt, Homo sapiens
acuaguggaagauaguguucugcuuauaauuaaacugaauguagaguaucucuguauguuaau

SEQ ID NO: 465 - RNA, 63 nt, Homo sapiens
acuauccaugaagggaaagcuccucagcauaacugcucagggaaauagggcuaaauaacugaa

SEQ ID NO: 466 - RNA, 63 nt, Homo sapiens
acuauuacauaacauacucaggacaaagaacuuugcucagggaacauaccauguaauauuuuu

SEQ ID NO: 467 - RNA, 63 nt, Homo sapiens
acuauuggaaggaguuagauguugguacuagauacugaauguaaacaaaggaauuauggcugg

SEQ ID NO: 468 - RNA, 62 nt, Homo sapiens
acucaaagugauauuuguacaccaguguuuguagcaguauuauucacaauagccaaaaggug

SEQ ID NO: 469 - RNA, 61 nt, Homo sapiens
acucagaucaaagacaaaaucugauccauauauuggugcuagauucugcaggaaaccccag

SEQ ID NO: 470 - RNA, 63 nt, Homo sapiens
acucagcccuuuauggcccauggggaacuccguggcucagggagagcugaacuccaggggugu

SEQ ID NO: 471 - RNA, 63 nt, Homo sapiens
acucauuuuauaucaacacgcuuggaggaaagggacucagggaagggagcagggagugugggg

SEQ ID NO: 472 - RNA, 63 nt, Homo sapiens
acuccaccucaaaaaauaaaaucaagauaaccucuugaauguaauagcucauagcacuuuaau

SEQ ID NO: 473 - RNA, 61 nt, Homo sapiens
acuccccagcguggccucacugucuucuggucuuggugcuacugaaauugucacccagaau

SEQ ID NO: 474 - RNA, 63 nt, Homo sapiens
acuccuaagagaguuguaaaaauagaggcuuggcuugaauguacauagaugguaccuggcaug

SEQ ID NO: 475 - RNA, 62 nt, Homo sapiens
acuccugaauuuaauuuccccaccuaagucgaaacaguauuaucaaaacacaugugcacaca

SEQ ID NO: 476 - RNA, 63 nt, Homo sapiens
acucggcagcccuuccaaacucuucccucucucacuccccacaucccaucgucucggccuuca

SEQ ID NO: 477 - RNA, 63 nt, Homo sapiens
acucucuuccccagaguguagacaggcagcaggucuccccacagcucugaaaggacccuggug

SEQ ID NO: 478 - RNA, 63 nt, Homo sapiens
acucugaccacacagaaccagggcugccccuguaauccccacaguaagaaaguuguauggcau

SEQ ID NO: 479 - RNA, 61 nt, Homo sapiens
acucuuccugccuuagucaccccuccaugggccuggugcuaagguggcuguggaugccaca

SEQ ID NO: 480 - RNA, 63 nt, Homo sapiens
acucuugacccuuuuuuuucagugauuagcaaaucuccccacaacccagguguggagagaaga

SEQ ID NO: 481 - RNA, 62 nt, Homo sapiens
acugaaucugcaaccacuuccacuuaaccuauaacuacuguaacuucuacuuagccuacagu

SEQ ID NO: 482 - RNA, 63 nt, Homo sapiens
acugaccagaggaugugaagccacugaaagcuugacucagggaaaagaaaugugggaccauca

SEQ ID NO: 483 - RNA, 63 nt, Homo sapiens
acugaccuguuguaggcagcuaucuuacagacgcaugaauguaagaguaggaaggggugggug

SEQ ID NO: 484 - RNA, 63 nt, Homo sapiens
acugacggggaaaaaaaaaaaaaaagaauggggugugaauguaccaacacugaaucuuacagc

SEQ ID NO: 485 - RNA, 64 nt, Homo sapiens
acugagauuucugaguauacuuuucauauugccuuaauguagcaguaauguguuuaugcauuug

SEQ ID NO: 486 - RNA, 63 nt, Homo sapiens
acugaggacuggacuguggugaccaugccgauuugcucagggagaacguugcaaugcacccag

SEQ ID NO: 487 - RNA, 63 nt, Homo sapiens
acugauacaaggccuggagagggcuguugggggcccucagggaggguucaacucugagacgag

SEQ ID NO: 488 - RNA, 64 nt, Homo sapiens
acugauuuguuuccaugcugauuguguggaaccaguauguagcaaauggaaagccuagaaauau

SEQ ID NO: 489 - RNA, 61 nt, Homo sapiens
acugcccagcuccgugggguggcaucugguuucuggugcuauucugccaaguuaucgagcu

SEQ ID NO: 490 - RNA, 63 nt, Homo sapiens
acugcgcccggccauggaccuggcugucuuuaucauccccacaaacauuuugaaacuggaaua

SEQ ID NO: 491 - RNA, 63 nt, Homo sapiens
acugcuuucuaauggggagggcugagggcucccuguccccacagcagguauguugggcucugc

SEQ ID NO: 492 - RNA, 62 nt, Homo sapiens
acuggccuuguucuccuuagcccgucacuccauacaguauuaggugaggauggaugcgggcg

SEQ ID NO: 493 - RNA, 63 nt, Homo sapiens
acugggccuggagcccugggcggaguccccgggguuccccacacagggcacugacugauagcu

SEQ ID NO: 494 - RNA, 63 nt, Homo sapiens
acugguaauauuuuuauuuccuauuggagagugaauccccacaguugcuuuuugugacuugau

SEQ ID NO: 495 - RNA, 63 nt, Homo sapiens
acugguaccugggggccugaauucuggcccccggcuccccacacagcugggacuggccuggau

SEQ ID NO: 496 - RNA, 63 nt, Homo sapiens
acuguacccagcugguugggaggaccagagccugucucagggaauugccugcuggggugaugc

SEQ ID NO: 497 - RNA, 64 nt, Homo sapiens
acuguccauauucauuguauaaagagaggucuacguauguagcauauaaaaccacaucacuaag

SEQ ID NO: 498 - RNA, 63 nt, Homo sapiens
acugugcuguauugcugcugaacuaaaugcacuuuuccccacauauggggcacuggcuucaaa

SEQ ID NO: 499 - RNA, 64 nt, Homo sapiens
acuguggauuauuucauuuuguaacaaaugaacgauauguagcagaaaggcacguccacucaca

SEQ ID NO: 500 - RNA, 62 nt, Homo sapiens
acuuaaaugugaaggaacaacagcaacaagaccaguaugauauaccaagguaauaaaugcug

SEQ ID NO: 501 - RNA, 63 nt, Homo sapiens
acuuacgcagggagaugcaggucucucuaaacgcaugaauguauguaguguguaggcacugua

SEQ ID NO: 502 - RNA, 64 nt, Homo sapiens
acuuauuccaagugcauuuuucuuauuuauaucuuuauguagcacuacuacagaaauucugcaa

SEQ ID NO: 503 - RNA, 63 nt, Homo sapiens
acuuauuucauaauugccuacauuuaucaugguccugaauguagcguguaagcuuguguuucu

SEQ ID NO: 504 - RNA, 63 nt, Homo sapiens
acuucccuccuuguuugucagccuccuguucauguuccccacacaccugaaggugguagaauc

SEQ ID NO: 505 - RNA, 64 nt, Homo sapiens
acuucuaaauuaaugguaaaauaaaaugccucagcuauguagcaaagggaaugggucugcacag

SEQ ID NO: 506 - RNA, 63 nt, Homo sapiens
acuucuaaguacauaaauaugugcagggagauuccuccccacagaguuuuuauucagaggguc

SEQ ID NO: 507 - RNA, 63 nt, Homo sapiens
acuucuguguuugggauguccuacuguaagacugaugaauguacagaguuaauuucaggguac

SEQ ID NO: 508 - RNA, 62 nt, Homo sapiens
acuugaauuuugucccuuuaaaacugcuguaccuguaugauaaagaugcaguaccuuucucu

SEQ ID NO: 509 - RNA, 62 nt, Homo sapiens
acuugagucguaagccuucuugcuuuugauaacacaguauuauuucucuuacuguagaagaa

SEQ ID NO: 510 - RNA, 61 nt, Homo sapiens
acuugccuaguuguacccaccccuccaggucccuggugcuagagcuucugagaagggccuu

SEQ ID NO: 511 - RNA, 62 nt, Homo sapiens
acuuggucaguguuaauaaaaucaaaacgugauucuacuguacauugcauuauucauaauuu

SEQ ID NO: 512 - RNA, 62 nt, Homo sapiens
acuuguaugugcggagucacacugcagugccgaacaguauuagcucccguucccaagugugg

SEQ ID NO: 513 - RNA, 62 nt, Homo sapiens
acuugugcuguaccaaaaugguaauuauaacagacaguauuagaauuacugaauuaacaaug

SEQ ID NO: 514 - RNA, 62 nt, Homo sapiens
acuuguuaggaaguagcuuaauuaccccccauugcaguauuauuguuauauauauaguuaau

SEQ ID NO: 515 - RNA, 63 nt, Homo sapiens
acuuguuuauccaacuaaguguccaaaaccuaaauugaauguacuaaguuuucacauguccca

SEQ ID NO: 516 - RNA, 64 nt, Homo sapiens
acuuuaaaaugguauuuguuuuacagcauacauaaaauguagcaaaucaguacuguaaaacauu

SEQ ID NO: 517 - RNA, 64 nt, Homo sapiens
acuuuaaaaugguauuuguuuuacagcauacauaaaauguagcaaaucgguacuguaaaacauu

SEQ ID NO: 518 - RNA, 63 nt, Homo sapiens
acuuuaacaccagguuuauggaaaaugucaggccuuccccacaacuccugucuaacugcuguc

SEQ ID NO: 519 - RNA, 62 nt, Homo sapiens
acuuuaaccaacauuuacguaaguacggucuuugcaguauuacacaauaccgcaugagcuaa

SEQ ID NO: 520 - RNA, 63 nt, Homo sapiens
acuuuagaacagaggauuguauugcaagacaaaguugaauguaaagugaucucccugaacauu

SEQ ID NO: 521 - RNA, 63 nt, Homo sapiens
acuuuagguauuacuacauaguugaaggauuuaacugaauguauggaucaaauuuauuuauuu

SEQ ID NO: 522 - RNA, 62 nt, Homo sapiens
acuuuauaugaaaaugaauauuuuacaguuugcacaguauuauuuuacagaaaaggaaucag

SEQ ID NO: 523 - RNA, 63 nt, Homo sapiens
acuuucuggauuucucuugaagugcuacacugcacugaauguaaggaauuguugcuuguggaa

SEQ ID NO: 524 - RNA, 62 nt, Homo sapiens
acuuugacugcuguuauuaccuauagcuaaguguguaugauaaugaaacucaucauuuuagu

SEQ ID NO: 525 - RNA, 63 nt, Homo sapiens
acuuugcaguaaguaucauguaaauaugcaaauguugaauguaauauagauuguguccucauu

SEQ ID NO: 526 - RNA, 62 nt, Homo sapiens
acuuugcuuuucuuuuucaaaucuccuaaugguaguaugauauagcauaguagaaggagauu

SEQ ID NO: 527 - RNA, 62 nt, Homo sapiens
acuuuuauuuuuuaaacaaugggcuaaaaauaaacaguauuaaaagguuaaguuuauauaau

SEQ ID NO: 528 - RNA, 63 nt, Homo sapiens
acuuuuucuuuaaaauucaauuaagguacuucucccucagggacguagaacaauggaauguca

SEQ ID NO: 529 - RNA, 62 nt, Homo sapiens
acuuuuuugaaagauuacuuuuuaggaacauuugguaugauaugcauaaaauuauuuaucca

SEQ ID NO: 530 - RNA, 63 nt, Homo sapiens
acuuuuuuuuuuuaacacacuaaucuucaguuggaugaauguaauguauaacuauguuuucag

SEQ ID NO: 531 - RNA, 61 nt, Homo sapiens
agaaaaaccaaaacccaacccugcauggucaaguggugcuaacccaagacuguaacaggga

SEQ ID NO: 532 - RNA, 63 nt, Homo sapiens
agaaaaagagacaaauuacccagaaaccccucccuuccccacauggaggccuuggcaaauguu

SEQ ID NO: 533 - RNA, 61 nt, Homo sapiens
agaaaaaggggcaguuuucuuugcccaagcauuuggugcuaguuagaggcuguucacucuc

SEQ ID NO: 534 - RNA, 64 nt, Homo sapiens
agaaaaauguguauuuuaagaugaaauauuuucuugauguagcagaauauuuccuaguucauuu

SEQ ID NO: 535 - RNA, 63 nt, Homo sapiens
agaaaagaaaggaccagucuucacuuucugcauuauccccacauuuuauucauucauccagau

SEQ ID NO: 536 - RNA, 63 nt, Homo sapiens
agaaaagagagaucuacuuuggugguuucucaggucucagggaaggucuuuuauaaacucaau

SEQ ID NO: 537 - RNA, 62 nt, Homo sapiens
agaaaaggaaauguuuuuaccuuaucuccuguauguaugauagaacuuaaaagaaaugugca

SEQ ID NO: 538 - RNA, 63 nt, Homo sapiens
agaaaccaccugcuacugcaaacggccucgcuguacucagggagucgguuccaggaccccaug

SEQ ID NO: 539 - RNA, 62 nt, Homo sapiens
agaaaccacugucucuagaagaaagcuuguuuugcaguauuagugaaucacugaauagcuua

SEQ ID NO: 540 - RNA, 64 nt, Homo sapiens
agaaagacugaaaccaagacuauuuaacugugaacuauguagcagauguuuuaaacuuuuuauu

SEQ ID NO: 541 - RNA, 63 nt, Homo sapiens
agaaagcuucaucuguggggaccagagacuuguugcucagggaguuagugaugggacuugggc

SEQ ID NO: 542 - RNA, 52 nt, Homo sapiens
agaaaugcagaaugcuuaaaaggcugaauguaggauucuucaguauguggaa

SEQ ID NO: 543 - RNA, 61 nt, Homo sapiens
agaaauuaauuugcaguguuuggauuguauauauggugcuaaaaauaaauuaauuuacuuu

SEQ ID NO: 544 - RNA, 62 nt, Homo sapiens
agaaauucacuggcucacugaaaagcaggauuuccuacuguacuuguuuuuaaaaaugugcc

SEQ ID NO: 545 - RNA, 62 nt, Homo sapiens
agaaauuuuuguuugauguaaucaauaaacuuugguaugauaugauugaugguaccuagugu

SEQ ID NO: 546 - RNA, 62 nt, Homo sapiens
agaacucauuuugugcaaugaacauaaggaaagacuacuguauagguuuuuuuuuuuuucuc

SEQ ID NO: 547 - RNA, 62 nt, Homo sapiens
agaacuggaagaacuguuggccaaguugaaguagcuacuguagacccuuucaugccagcagu

SEQ ID NO: 548 - RNA, 51 nt, Homo sapiens
agaagaaagcaagucauaaaagccucagggaggccauuuuugccuaaauuu

SEQ ID NO: 549 - RNA, 54 nt, Homo sapiens
agaagacacauacaaguaaggaccuguccccacaacaaggacccuguguggagc

SEQ ID NO: 550 - RNA, 63 nt, Homo sapiens
agaagacagacuaucauuccugaggcaugaaaauucucagggacaaagccaugccucagucac

SEQ ID NO: 551 - RNA, 54 nt, Homo sapiens
agaagauacuugcuguugaggcugggcuacuguauacaguguacaauguguauu

SEQ ID NO: 552 - RNA, 63 nt, Homo sapiens
agaaggaaucuuauagauuccagaacucaggauaccucagggauaggucacagccaagaguac

SEQ ID NO: 553 - RNA, 63 nt, Homo sapiens
agaaggaggggagcaggcccguggcaggaggagggcucagggagcugagaucccgacaagccc

SEQ ID NO: 554 - RNA, 63 nt, Homo sapiens
agaaggcuauucugauauaauaacacaaugcucagcucagggagcaaguguuuccgucauugu

SEQ ID NO: 555 - RNA, 63 nt, Homo sapiens
agaagucauacuggugagaaacccuuugaauguaaugaaugugggaaagcauucucucaaaga

SEQ ID NO: 556 - RNA, 62 nt, Homo sapiens
agaaguucauauuuugugacaucugcauugauuucaguauuacugaugguacuguuauucau

SEQ ID NO: 557 - RNA, 63 nt, Homo sapiens
agaauagcauauagagaauaaucauguugacuuugugaauguagaaaagcuuuuaucuauuac

SEQ ID NO: 558 - RNA, 63 nt, Homo sapiens
agaauccauacuagugagaaaccacgugaauguaaugaaugugggaacgcuuugaucagagga

SEQ ID NO: 559 - RNA, 64 nt, Homo sapiens
agaaugaaaauuguugagguuaucucccauucaaucauguagcaagaacuuaaagaaauucacu

SEQ ID NO: 560 - RNA, 62 nt, Homo sapiens
agaaugaaucucuuacaccucuacuuuugccccucuacuguauauuaagcccauaggcuugu

SEQ ID NO: 561 - RNA, 62 nt, Homo sapiens
agaaugcuagguaaucuucguagaaaacuagaaaguaugauaaacaacaguuggaggaaucc

SEQ ID NO: 562 - RNA, 63 nt, Homo sapiens
agaaugggugcaguuugaggggccuguguggaggccucagggagauguuggacugugccugga

SEQ ID NO: 563 - RNA, 63 nt, Homo sapiens
agaauucacacaggagagaaagcacaugaauguaaugaauguggaaaagcuuucagucaaacc

SEQ ID NO: 564 - RNA, 63 nt, Homo sapiens
agaauucacaguggggagaaacccuaugaauguaaugaaugugggaaugccuucauuuguuuu

SEQ ID NO: 565 - RNA, 63 nt, Homo sapiens
agaauucauaccagugugaaacccuaugaauguaaggaauguguaaagaccuuuacuuggcuu

SEQ ID NO: 566 - RNA, 63 nt, Homo sapiens
agaauuccuacuggugagaaacccuaugaauguaaugaaugugagaaggccucuucuugucuu

SEQ ID NO: 567 - RNA, 63 nt, Homo sapiens
agaauuuuuugugcagaaagcccuaaauucccaccugaauguaacuuacagcucccuuaccua

SEQ ID NO: 568 - RNA, 63 nt, Homo sapiens
agacacucacuauuuucaugaacaguuacccucuguccccacaaccaaagacaacucauggcc

SEQ ID NO: 569 - RNA, 63 nt, Homo sapiens
agacaucagagaauucacaguggggagaaacccuaugaauguaaugaaugugggaaugccuuc

SEQ ID NO: 570 - RNA, 63 nt, Homo sapiens
agacaugaaaggaugcacacugcaaagaaacaguaugaauguaaaaaaugugggaaaacauac

SEQ ID NO: 571 - RNA, 64 nt, Homo sapiens
agaccaaaaugaaaguuuuuuccucccugcuuaaaaauguagcagcuucuuaguuacuuuggaa

SEQ ID NO: 572 - RNA, 63 nt, Homo sapiens
agaccaggcuggugucacguccauccgagcgcugccucagggaucgauaaaguuucacugcag

SEQ ID NO: 573 - RNA, 61 nt, Homo sapiens
agacccuugggagguggcccuaucccuaggcaguggugcuaggaggacagaaggcuauaug

SEQ ID NO: 574 - RNA, 63 nt, Homo sapiens
agacuacugaccuucucaccuccacccauaccuucuccccacagccucugcugaugcacagag

SEQ ID NO: 575 - RNA, 61 nt, Homo sapiens
agacugagcaccugcuucaugcucagcccugacuggugcuauaggcuggagaagcucaccc

SEQ ID NO: 576 - RNA, 63 nt, Homo sapiens
agacuguauuuggcauagaauuuggaaauguaacuugaauguaaauaugcugcaaaauguuga

SEQ ID NO: 577 - RNA, 63 nt, Homo sapiens
agacuugggaccuuccugaacuuggggccuaucacuccccacaguggaugccuuagaagggag

SEQ ID NO: 578 - RNA, 63 nt, Homo sapiens
agacuugguucuaguccaauuucugccacugaggaugaauguaacugugggcaaacuauuuac

SEQ ID NO: 579 - RNA, 62 nt, Homo sapiens
agacuuuugugaaaagcugauaccucaaucuuuacuacuguauuuuuaaaaaugaagguugu

SEQ ID NO: 580 - RNA, 63 nt, Homo sapiens
agagaacacagaagaaaagcaauugccccagguccuccccacagucaagggagcucuuccuuc

SEQ ID NO: 581 - RNA, 64 nt, Homo sapiens
agagaacucaaaauggagagaaaucucauuuaagagauguagcaaaguguucacuaagaguguu

SEQ ID NO: 582 - RNA, 62 nt, Homo sapiens
agagaagaaaucaguaucugaguugcauaccaggcaguauuaaaaucuaacaggucuguuug

SEQ ID NO: 583 - RNA, 62 nt, Homo sapiens
agagaagacuuaggccugguuuacagaguguucuguaugauaugcagguaccacccuaaagu

SEQ ID NO: 584 - RNA, 62 nt, Homo sapiens
agagaauccaaguguuagaaggagaacaaaaauucaguauuauacagaucuaaaacucgcaa

SEQ ID NO: 585 - RNA, 63 nt, Homo sapiens
agagagacagagacccaaagggagagaaacagagacucagggagagggagacaaugaccugga

SEQ ID NO: 586 - RNA, 61 nt, Homo sapiens
agagagcauagcugcuuccaucucuuacccaaguggugcuaaacaauuuuucuuccaaugu

SEQ ID NO: 587 - RNA, 63 nt, Homo sapiens
agagagggaagcagaaggcaggcauuuuucuauuuuccccacaaauuauuucaaaaaaaaucu

SEQ ID NO: 588 - RNA, 63 nt, Homo sapiens
agagagugaggcugggcaggggucugcggcccuuucucagggacacacccugauagcacaauc

SEQ ID NO: 589 - RNA, 61 nt, Homo sapiens
agagaguucaagggcaggcacauaguugauaacuggugcuaguucuucuauuuaauuauau

SEQ ID NO: 590 - RNA, 64 nt, Homo sapiens
agagaugugggccguggcccaaccguccuauaugagauguagcaugguacagaacaaacugcuu

SEQ ID NO: 591 - RNA, 62 nt, Homo sapiens
agagcaacaguauuccucaauccugucuguucugcaguauuaagcuaagaacagguaaaaca

SEQ ID NO: 592 - RNA, 62 nt, Homo sapiens
agagcaagacuccaucucauaaauuaaaaggaaaguaugauaguguuauggauuuuagcucu

SEQ ID NO: 593 - RNA, 63 nt, Homo sapiens
agagccccaccuccuaacaccauggauucaaagugcucagggaauuugccucuccuugcccca

SEQ ID NO: 594 - RNA, 63 nt, Homo sapiens
agagcccugggcuggaggcugagcugcaucccugcuccccacauggaggacccaacaggaggc

SEQ ID NO: 595 - RNA, 63 nt, Homo sapiens
agagcccuugggagaccagcuguugcucccaccuuuccccacagggugcccgguccccacggc

SEQ ID NO: 596 - RNA, 63 nt, Homo sapiens
agagccguauguacucagccuuuccuauugggccuuccccacaauuagaauauuuugacuuag

SEQ ID NO: 597 - RNA, 63 nt, Homo sapiens
agagcgacccucacaaggcccaaguccucccagagcucagggaagcugucgcuucugacagaa

SEQ ID NO: 598 - RNA, 63 nt, Homo sapiens
agagcuccaaauugguggcauuauccuuucaaaaucucagggauuugggaugaagugaagagg

SEQ ID NO: 599 - RNA, 63 nt, Homo sapiens
agaggcuguucuggaaggcuucuugucuucugacguccccacagcccugggccccucgugucu

SEQ ID NO: 600 - RNA, 63 nt, Homo sapiens
agaggcuuaagagagaaacaccgaaauucagauagcucagggacugcuaacagagaacuacau

SEQ ID NO: 601 - RNA, 62 nt, Homo sapiens
agagguugcagugagcugagaucacacuacuguacuacuguacuccagccugggggaaagag

SEQ ID NO: 602 - RNA, 63 nt, Homo sapiens
agaguaugugagccaugccuugcccuuuucugaggcucagggaaguggauggagcuagagaga

SEQ ID NO: 603 - RNA, 63 nt, Homo sapiens
agaguucacacuagagaaaggccuuaugaauguagugaaugugggaaauccuuuagcuuaagg

SEQ ID NO: 604 - RNA, 64 nt, Homo sapiens
agaguucaccucuacucugcccuccucauagucauaauguagcaaguaaagaaugagaauggau

SEQ ID NO: 605 - RNA, 63 nt, Homo sapiens
agaguucauaaauuuacuugagguugccucaagaacucagggaacaauacuguaaacugucuu

SEQ ID NO: 606 - RNA, 62 nt, Homo sapiens
agaguuccuggagggaaggaugaaggagccuuggcuacuguacucugagaggaauguuucca

SEQ ID NO: 607 - RNA, 64 nt, Homo sapiens
agaguuucuguuaggaaaagccauacauuuuuaaaaauguagcaaaaugucaagggaaauguaa

SEQ ID NO: 608 - RNA, 62 nt, Homo sapiens
agaguuugcagcugguaaaaccagaggcuacauccaguauuacugcuaagagacauucuuca

SEQ ID NO: 609 - RNA, 64 nt, Homo sapiens
agauaacucuauugggcggcgggaacagaaaggaacauguagcaaucacuccucuucauccaug

SEQ ID NO: 610 - RNA, 63 nt, Homo sapiens
agauacauuaaaauacucacugaagagaagcccuaugaauguaaguaacgugggaaagcauga

SEQ ID NO: 611 - RNA, 64 nt, Homo sapiens
agaucagccccuucuguguuaacaguuuuucucacaauguagcaacuuuuauccacccuucagg

SEQ ID NO: 612 - RNA, 62 nt, Homo sapiens
agaucucuacauauauauauauauauaaauacaacuacuguacucucugcaucuguacaaag

SEQ ID NO: 613 - RNA, 64 nt, Homo sapiens
agaugagagccaaugucagauaaaguaagcauaguaauguagcaggaacuacaauagaagacau

SEQ ID NO: 614 - RNA, 63 nt, Homo sapiens
agaugcagucccaggcauccuccugccccugggcucucagggacccccugggucggcuucugu

SEQ ID NO: 615 - RNA, 61 nt, Homo sapiens
agaugcucacugagcugcugcuuuuaugugugcuggugcuauguguguucauguccgcggc

SEQ ID NO: 616 - RNA, 61 nt, Homo sapiens
agaugcugccacaggaccugagacacugaugaauggugcuauuuuggacuuucaacaugcu

SEQ ID NO: 617 - RNA, 62 nt, Homo sapiens
agauggcauagugucagauguaccuuacucucugcuacuguacagcuuuaggauuugucauc

SEQ ID NO: 618 - RNA, 61 nt, Homo sapiens
agaugggccacugacugagcacugccccgucccuggugcuacuggucuuucuaaacuuagc

SEQ ID NO: 619 - RNA, 63 nt, Homo sapiens
agaugguguggugaugaagccugcuggguauacagcucagggaaagucaucgaugauggcuca

SEQ ID NO: 620 - RNA, 63 nt, Homo sapiens
agauuggaaguugaaauggcugagauuuggugaucuccccacagcuggcucugcaaguuaccu

SEQ ID NO: 621 - RNA, 63 nt, Homo sapiens
agauuucaaauccaggggauuccaugcucaauggaugaauguagacacaaaacagcaacacuu

SEQ ID NO: 622 - RNA, 63 nt, Homo sapiens
agauuugccugcuggaaucauaauccauuuuuaagugaauguaagaaaugaaaacuacugcau

SEQ ID NO: 623 - RNA, 62 nt, Homo sapiens
agauuuuagauguauaauguuguuaaaguacauacuacuguaaaaauaugggaugaauuuua

SEQ ID NO: 624 - RNA, 61 nt, Homo sapiens
agcaaaaauuuaagguuuuauugggggaggggguggugcuacuuccucuguaacauguuuu

SEQ ID NO: 625 - RNA, 62 nt, Homo sapiens
agcaacagcagcucccauuucuagaacacauuuacaguauuacuauuuucuaggauauaaag

SEQ ID NO: 626 - RNA, 62 nt, Homo sapiens
agcaaggggaguuugagggaaucagagcuugaugcuacuguacagaacuggacagguugggc

SEQ ID NO: 627 - RNA, 62 nt, Homo sapiens
agcaauagggaaaggacucucuauucaauuaauccuacuguauaucuggcuagccauaugca

SEQ ID NO: 628 - RNA, 63 nt, Homo sapiens
agcacacacauacacaccaccaccaacaacgcuugugaauguauuuuucuguuagcuggguuu

SEQ ID NO: 629 - RNA, 63 nt, Homo sapiens
agcaccaaauuuuguuguuuuuuuuuuuucuccccuccccacagaucccaucucaaaucauuc

SEQ ID NO: 630 - RNA, 62 nt, Homo sapiens
agcaccgaaagcaucauaguuuuuccccaguuauauguagcauaaaugguuuaaucauaaau

SEQ ID NO: 631 - RNA, 63 nt, Homo sapiens
agcacuaaaccagggccaggguccccggggaggaguccccacagcggccccucaucagccugu

SEQ ID NO: 632 - RNA, 59 nt, Homo sapiens
agcacucacgguccacugaaagcucugaauccucagggaugccaccugcacauucucau

SEQ ID NO: 633 - RNA, 63 nt, Homo sapiens
agcacugaguucccccuuaagacaccuccacacccuccccacaagcaaagcacaaauuuuggg

SEQ ID NO: 634 - RNA, 63 nt, Homo sapiens
agcacuggggaaaagguugaauggagucacugagacucagggaucuguguccuagacagucag

SEQ ID NO: 635 - RNA, 62 nt, Homo sapiens
agcagaaucuccgugggacaucuuucuggagcaucaguauuacugcaggauuuggaagaaac

SEQ ID NO: 636 - RNA, 63 nt, Homo sapiens
agcagagcuguagcugacuguggcauuacuacgccuccccacacgcccagaccccucacucca

SEQ ID NO: 637 - RNA, 63 nt, Homo sapiens
agcagcugcuucggauccacacuguaucugugucauccccacauggguccucauaaaggauua

SEQ ID NO: 638 - RNA, 63 nt, Homo sapiens
agcagggagaaacuaagucgcaccauuuagcuaagcucagggacaacguucauuuauaauaaa

SEQ ID NO: 639 - RNA, 63 nt, Homo sapiens
agcaguauucuucaguaaauaaagaauggaauugcugaauguaaucauugaaccucgagucac

SEQ ID NO: 640 - RNA, 64 nt, Homo sapiens
agcaguguugaagcugggaauuuuuuggcgcaauccauguagcagugacccaggcuugggagcc

SEQ ID NO: 641 - RNA, 62 nt, Homo sapiens
agcauacaaugcauacuguuggagaacaagaaugcuacuguauuuuacaucuuuauuucuug

SEQ ID NO: 642 - RNA, 63 nt, Homo sapiens
agcauauaaugagaugcuugaugaauggugcauauugaauguauaaagcccaccgguccugag

SEQ ID NO: 643 - RNA, 64 nt, Homo sapiens
agcauauaaugauaugugcaagauugaaucuuuucaauguagcacaugucuguaggguuauaca

SEQ ID NO: 644 - RNA, 63 nt, Homo sapiens
agcaucuuuguauauugcaauauacuugaaaaaaaugaauguauuuuuuucuccaaagaacag

SEQ ID NO: 645 - RNA, 63 nt, Homo sapiens
agcauguaagggacucacacuggagagaaaccauaugaauguaaagauugugggaaauccuuc

SEQ ID NO: 646 - RNA, 62 nt, Homo sapiens
agcauucaggcuggaaaacacugauguggacucaguaugauaacugagaugggggacgccag

SEQ ID NO: 647 - RNA, 63 nt, Homo sapiens
agccaaaauauucucuggacaacaaauuuguauugcucagggacaguuuaccuugccugguaa

SEQ ID NO: 648 - RNA, 62 nt, Homo sapiens
agccaacuagccccugggguggccaccaguaugacaguauuauacgcuggcaacacagaggc

SEQ ID NO: 649 - RNA, 64 nt, Homo sapiens
agccaauacaauuagucaaaccacuguuauuaacagauguagcaacaugagaaacgcuuauguu

SEQ ID NO: 650 - RNA, 63 nt, Homo sapiens
agccaaucagaucaacucugucuugggcguuugaacucagggagggaggcccuugggagcagg

SEQ ID NO: 651 - RNA, 62 nt, Homo sapiens
agccacugcacccggcuugaaucauccuuuuguccaguauuauauccaugcuguauaugcua

SEQ ID NO: 652 - RNA, 63 nt, Homo sapiens
agccaugcacccgcccagccaccacgucccccgcaugaauguacuguacacuuucaauccucc

SEQ ID NO: 653 - RNA, 63 nt, Homo sapiens
agccauggcugaacuaucagggacaaaggcccauguccccacaucccugcucccuccuuccuc

SEQ ID NO: 654 - RNA, 63 nt, Homo sapiens
agccauucuggacaccaggggaccuggacggaggguccccacagcccgugccccacgccgccu

SEQ ID NO: 655 - RNA, 63 nt, Homo sapiens
agcccaguguccacggagccgcggggccagaggagcucagggagaccuggcugucuagggcau

SEQ ID NO: 656 - RNA, 62 nt, Homo sapiens
agcccuguaacaggcuugaaucaaagaacuucuccuacuguagcaaccugaaauuaacucag

SEQ ID NO: 657 - RNA, 63 nt, Homo sapiens
agccgguaccugggaagggggagagugcaggccugcucagggacuguuccugucucagcaacc

SEQ ID NO: 658 - RNA, 61 nt, Homo sapiens
agccucaggcucuccugcccugggccucccaauuggugcuaucuguuacugcccgugcuca

SEQ ID NO: 659 - RNA, 63 nt, Homo sapiens
agccucggugccagaguggugggcagaucugaccauccccacagaccagaaacaaggaauuuc

SEQ ID NO: 660 - RNA, 63 nt, Homo sapiens
agccuggcucuaucuuccuccuugugaucgucccauccccacaucccgugcaccccccaggac

SEQ ID NO: 661 - RNA, 61 nt, Homo sapiens
agcggcgaacgccaggcucugggcuccggcgacuggugcuacgcaucccgcggagcuucug

SEQ ID NO: 662 - RNA, 62 nt, Homo sapiens
agcuaacuuuuaaguggauuuugcaaaugaaaaccaguauuacugaguuuuacauacucgaa

SEQ ID NO: 663 - RNA, 63 nt, Homo sapiens
agcuacuuucuguaugcacaagcuucccagcuuuguccccacaguguaccuuuuugcuaaaac

SEQ ID NO: 664 - RNA, 63 nt, Homo sapiens
agcuaguuuuuacucucuuccauaauuucauuacaugaauguaagaugauggcucaaaaauga

SEQ ID NO: 665 - RNA, 62 nt, Homo sapiens
agcuaucauguaaaaacuacauaaggugguugugcuacuguauaauugggggugauaauacc

SEQ ID NO: 666 - RNA, 63 nt, Homo sapiens
agcucacccaauaaacauuaagauugaggccugcccucagggaucuugcauucccagugguca

SEQ ID NO: 667 - RNA, 64 nt, Homo sapiens
agcuccaguuucaugugaaauagaguuuccagauuuauguagcauggaaaguuuuaauacguca

SEQ ID NO: 668 - RNA, 63 nt, Homo sapiens
agcucccagagagacugccuucccuacacuagaaguccccacaaaggcuucugagaccacaaa

SEQ ID NO: 669 - RNA, 63 nt, Homo sapiens
agcucuaugcuaaauaaugaagaguagcacaagaaugaauguauuugcugauacguugcucac

SEQ ID NO: 670 - RNA, 63 nt, Homo sapiens
agcucuccaaagaguguguccaccacuccacugugcucagggaaggcagaccucuccucucuc

SEQ ID NO: 671 - RNA, 63 nt, Homo sapiens
agcucucucuccucucccugcuuccccuucaccauuccccacauucugcaaggacaggagcca

SEQ ID NO: 672 - RNA, 64 nt, Homo sapiens
agcucugagugggcuaagguugcuaaaacuaaguucauguagcaaacucucaaugauaagggag

SEQ ID NO: 673 - RNA, 63 nt, Homo sapiens
agcugaacagugaugaucuguagacauuuauggacugaauguaaugguugauauauguacauu

SEQ ID NO: 674 - RNA, 63 nt, Homo sapiens
agcugaagguuggagaaaugccagcugcccuuucguccccacacuguggaggaagggaccugu

SEQ ID NO: 675 - RNA, 64 nt, Homo sapiens
agcugagcuuuugaugccaggugcaaucuacuggaaauguagcacuuacguaaaacauuuguuu

SEQ ID NO: 676 - RNA, 63 nt, Homo sapiens
agcugauguugccaagggaucccaucaaggccaaacucagggaggaugaggccauggcauucu

SEQ ID NO: 677 - RNA, 63 nt, Homo sapiens
agcugauuuaacagcauagagcacagcgcccuacuuccccacagacaggcugaauuagaagcc

SEQ ID NO: 678 - RNA, 63 nt, Homo sapiens
agcugcaucugcacagcgcugucuccaauacugguuccccacaucaaaggcagagggagaaaa

SEQ ID NO: 679 - RNA, 63 nt, Homo sapiens
agcugcgcgggcuuauuuauuaacaggauaacccuugaauguagcagccccgggagggcggca

SEQ ID NO: 680 - RNA, 63 nt, Homo sapiens
agcuggccacccuggccucagcucccucaggacgccucagggaucucgcugcgcgguccuaua

SEQ ID NO: 681 - RNA, 63 nt, Homo sapiens
agcugggcaggucuccucugggaggucuuggccgacucagggaccuaagccacguuaagucca

SEQ ID NO: 682 - RNA, 63 nt, Homo sapiens
agcugucccacagcggucgggccugggccguuaucuccccacaacccccagccaaucaggacu

SEQ ID NO: 683 - RNA, 62 nt, Homo sapiens
agcuguguccaggaguucagggaacaaaauaaggcuacuguaacuucagucaacuucaaggc

SEQ ID NO: 684 - RNA, 63 nt, Homo sapiens
agcuguguuuagccccuccagauggaaguuucacuugaauguaaaauaauaaaguuuauauuu

SEQ ID NO: 685 - RNA, 62 nt, Homo sapiens
agcuucguacaaaugugaaguauuaauauuaucgcaguauuauuguuguuauuauuauuguu

SEQ ID NO: 686 - RNA, 64 nt, Homo sapiens
agcuucugaguugaauuugccuuugcacgcugaggaauguagcaugacguuaagauuucaggga

SEQ ID NO: 687 - RNA, 61 nt, Homo sapiens
agcuuugcucugagugccuacaaagcuaaugcuuggugcuagaaacaucaucauuauuaaa

SEQ ID NO: 688 - RNA, 64 nt, Homo sapiens
aggaaaaaaaaacacacacacacaaacauuuuuucaauguagcaaaaucaaacuuucugugggc

SEQ ID NO: 689 - RNA, 63 nt, Homo sapiens
aggaaagcuaagucuugucucauuuaggacuggguuccccacagugacagucacuuccuucag

SEQ ID NO: 690 - RNA, 63 nt, Homo sapiens
aggaagaauacugagugccuucauuuaacuaaaguugaauguaaaagucaauuugcacuucuu

SEQ ID NO: 691 - RNA, 63 nt, Homo sapiens
aggaaggcagacucuacacaugucagauugacauauccccacaauuuccggaaccuacaugua

SEQ ID NO: 692 - RNA, 63 nt, Homo sapiens
aggaagggaggcguuagaggagcugccuucggaggcucagggagucccuuuggagcugguugu

SEQ ID NO: 693 - RNA, 64 nt, Homo sapiens
aggaauuaccagcuggaaaccgacuuauucauguuaauguagcauaauauauaacaaggcauca

SEQ ID NO: 694 - RNA, 62 nt, Homo sapiens
aggacagaaaccacuuaguuuuuaauaaguggcucaguauuacaauugcagcgaugccuggc

SEQ ID NO: 695 - RNA, 62 nt, Homo sapiens
aggacagcaguccauuaagcacacuuugcugcuucuacuguaaaggcagccuuuaaaacaua

SEQ ID NO: 696 - RNA, 63 nt, Homo sapiens
aggaccaccuccuuccugccucauuguaauaaaauuccccacacugaggccuucuugucuuca

SEQ ID NO: 697 - RNA, 61 nt, Homo sapiens
aggaccacgucucacccagggugacaucaggaauggugcuagccucugcaacacgacaccc

SEQ ID NO: 698 - RNA, 63 nt, Homo sapiens
aggaccuagcuguuguaaagaauuggucuuaauguugaauguauuuugguugcugauguuuau

SEQ ID NO: 699 - RNA, 63 nt, Homo sapiens
aggacugaacuuuuucucaucaaaacuagcuuuuuuccccacaaauaaauuaucagguuaaac

SEQ ID NO: 700 - RNA, 62 nt, Homo sapiens
aggacugauacaaagaaagugcaugaggcaaugucaguauuaucugacaucuuucuuuucag

SEQ ID NO: 701 - RNA, 63 nt, Homo sapiens
aggagaccacggggagcaaaccagcuuguucugggcucagggagggagggcgguggacaauaa

SEQ ID NO: 702 - RNA, 63 nt, Homo sapiens
aggagaguagcugccuguugcaccugcuccacaccuccccacagccucccugcaggugcugug

SEQ ID NO: 703 - RNA, 61 nt, Homo sapiens
aggagcacuccacagucggagguguaaucauauuggugcuauuucuuggaagagaaguuau

SEQ ID NO: 704 - RNA, 63 nt, Homo sapiens
aggaggaggaagagggugaccagggcauguggcuucucagggacauugcguucagcugcacuc

SEQ ID NO: 705 - RNA, 62 nt, Homo sapiens
aggaguagaaagaugcucauagcacacgcgauauguaugauaacauauuuuguuucaucuug

SEQ ID NO: 706 - RNA, 63 nt, Homo sapiens
aggcaaggcacucggccaauccgcaucucagcccucucagggagcagucuuccaucaugcuga

SEQ ID NO: 707 - RNA, 64 nt, Homo sapiens
aggcacccuggcugcguuccugauaaugccuagagcauguagcaauguucaaggcaggugccuu

SEQ ID NO: 708 - RNA, 64 nt, Homo sapiens
aggcacucuuaaaugaucugccucuaaaagcguuggauguagcauuaugcaauuagguuuuucc

SEQ ID NO: 709 - RNA, 62 nt, Homo sapiens
aggcacugggacaucacaggcuucaguaccugaccaguauuaguugcauauaucauugaaca

SEQ ID NO: 710 - RNA, 61 nt, Homo sapiens
aggcaggaccuucggccuaagaaacacaggcccuggugcuaucugaccugggguccagcga

SEQ ID NO: 711 - RNA, 63 nt, Homo sapiens
aggccagccggccucucgagagccagagcagcaguugaauguaaugcuggggacaggcaugcu

SEQ ID NO: 712 - RNA, 64 nt, Homo sapiens
aggccauucguuaccuacuuuucagcagcccacaagauguagcacuauuagugucccccucaga

SEQ ID NO: 713 - RNA, 63 nt, Homo sapiens
aggccccggaccaccggccccaggccccggcaagauccccacaaggcuggacugagccacuau

SEQ ID NO: 714 - RNA, 63 nt, Homo sapiens
aggccuccccgaggcagaaguugccugguccucuguccccacagugaccugacugggggugag

SEQ ID NO: 715 - RNA, 61 nt, Homo sapiens
aggccuucucuacaaccuaguccaucucacuucuggugcuaccugaguuggacagaauucu

SEQ ID NO: 716 - RNA, 63 nt, Homo sapiens
aggcgggauuggauggagucuugguguuuugccuucucagggaccaaaaauguaucauugacu

SEQ ID NO: 717 - RNA, 63 nt, Homo sapiens
aggcugguggcauggccccccugccccgugcugaaugaauguacagagccagacaaagcugug

SEQ ID NO: 718 - RNA, 62 nt, Homo sapiens
aggcuucugagugaaauagaaugauuugaaaccacuacuguauugccuggauacacacacac

SEQ ID NO: 719 - RNA, 64 nt, Homo sapiens
agggaacaugguuugacucaucuuauaugggaaaccauguagcagugagucauaucuuaauaua

SEQ ID NO: 720 - RNA, 64 nt, Homo sapiens
agggaacugucacuacccccucuaggaaguuauuuuauguagcauguuugcauauacgcauugu

SEQ ID NO: 721 - RNA, 63 nt, Homo sapiens
agggacacuugugucaggauugguccuuggugggccucagggaaugggcaugaggcacgauga

SEQ ID NO: 722 - RNA, 63 nt, Homo sapiens
agggagagggaggaacaacccugggcagacggggccucagggaccuguguccuuccgccucca

SEQ ID NO: 723 - RNA, 62 nt, Homo sapiens
agggaggggagugcuuucugccccaugccuccaacuacuguaugcaggccuggcucucuggu

SEQ ID NO: 724 - RNA, 61 nt, Homo sapiens
agggagucagaauauauuuguaaguuaaaucauuggugcuaauaauaaauguggauuuugu

SEQ ID NO: 725 - RNA, 62 nt, Homo sapiens
agggauaaaccuaucccuguuuucuuccugcacuguaugauaauaccaaaauuugggacagu

SEQ ID NO: 726 - RNA, 63 nt, Homo sapiens
agggcacacacugaaguuggcuuuucagccagcacugaauguauccaucaggacaugcgucuu

SEQ ID NO: 727 - RNA, 63 nt, Homo sapiens
agggcacuuggccaguuuucuguucagcuuuucagugaauguaccccuuuaagguucagacuu

SEQ ID NO: 728 - RNA, 63 nt, Homo sapiens
agggcagcacggagccuggggaccuggguuccuggcucagggagagcuguggcuucucauggg

SEQ ID NO: 729 - RNA, 63 nt, Homo sapiens
agggcaguuuggugcaauuuauguuaaaugccauuugaauguaaucaccuguguuaccacgaa

SEQ ID NO: 730 - RNA, 61 nt, Homo sapiens
agggcccagugaggacauccgccucccugaaaguggugcuagacagagcugaggucauugu

SEQ ID NO: 731 - RNA, 63 nt, Homo sapiens
agggccccuggacugucguggcuccccucaucagcuccccacaccagucaaggcuucucagcu

SEQ ID NO: 732 - RNA, 63 nt, Homo sapiens
agggccuacaccccucccuuuuuggggggagccuguccccacacaccuuagcacaaccagaau

SEQ ID NO: 733 - RNA, 63 nt, Homo sapiens
agggccuccauugucaacuguaaugaauauuauuuuccccacagaagguugugccauuucaca

SEQ ID NO: 734 - RNA, 63 nt, Homo sapiens
agggcgugggucucugggguuggggucccuugcugcucagggaggcaguacugacugggcacu

SEQ ID NO: 735 - RNA, 63 nt, Homo sapiens
agggcugaguguccagcacaccugccgucuucacuuccccacaggcuggcgcucggcuccacc

SEQ ID NO: 736 - RNA, 63 nt, Homo sapiens
agggcuggauagauuaucuaagucaagcuugagaaugaauguauguaauuuuccuguuuauug

SEQ ID NO: 737 - RNA, 62 nt, Homo sapiens
agggcuuucacugugauuuacugcauugcaggcuguaugauaaaacacacauaauuuaaaga

SEQ ID NO: 738 - RNA, 62 nt, Homo sapiens
aggggaauuucaggggacagagaugggauuuguuguaugauaaacuguauguaguuuuuagu

SEQ ID NO: 739 - RNA, 63 nt, Homo sapiens
aggggagcacggggugagucaaccugggacucggucucagggauaugccuaccaauagcgggu

SEQ ID NO: 740 - RNA, 63 nt, Homo sapiens
aggggagggauccucugggugauggccucuuccuccucagggaccucugacugcucugggcca

SEQ ID NO: 741 - RNA, 63 nt, Homo sapiens
agggggaacauuguaaagaaacaaaaagguccagaugaauguaugcuagaaauaaaaguugaa

SEQ ID NO: 742 - RNA, 64 nt, Homo sapiens
agggggaggcauauuauaaaaugcuauaauauaaaaauguagcaaaaacuugacagacuagaaa

SEQ ID NO: 743 - RNA, 63 nt, Homo sapiens
agggguucucaauggaaaaacgaaugcucuuacacugaauguacaggcagugggcuugcagca

SEQ ID NO: 744 - RNA, 63 nt, Homo sapiens
agggucucucccucagguguuuuuuaugaagugcgugaauguauguaaugugugguggccuca

SEQ ID NO: 745 - RNA, 63 nt, Homo sapiens
aggguggcuuuguucuuuguuuaaguuuuuuuuccugaauguaguuaauuuauggcaucuguu

SEQ ID NO: 746 - RNA, 63 nt, Homo sapiens
aggguuggggcagucccaugaccccaugucccagcuccccacacagcgcugggccagagaggc

SEQ ID NO: 747 - RNA, 63 nt, Homo sapiens
agguaacaaauuuggggaagacagcacaaucuucuugaauguagcucuugggaaugcauuauu

SEQ ID NO: 748 - RNA, 62 nt, Homo sapiens
agguacaaagccagaggacugugcuauucaaggacuacuguaagucuauuguuucucaaaag

SEQ ID NO: 749 - RNA, 63 nt, Homo sapiens
agguauuucuaugucaaaggcacagccuugaugaucucagggaaaaauuuuaaucacugugua

SEQ ID NO: 750 - RNA, 63 nt, Homo sapiens
aggucaugucaugccccaaaguguggggacagagccucagggagccccgagcaugguccagcc

SEQ ID NO: 751 - RNA, 63 nt, Homo sapiens
agguccugaauuuuacuuugccuuaagaagugcccuccccacaaugcaggagaggcacagagu

SEQ ID NO: 752 - RNA, 63 nt, Homo sapiens
aggucuagugagcuguagaauugaaucaaugugaacucagggaacuggggaaggcugagccuc

SEQ ID NO: 753 - RNA, 63 nt, Homo sapiens
aggucugugcuaccucugugagguauauacuaaaaugaauguaaaauaaggaucguauucccu

SEQ ID NO: 754 - RNA, 63 nt, Homo sapiens
aggugaccugcucucuuuccugggcccugccccucuccccacauguaucccucggucugaauu

SEQ ID NO: 755 - RNA, 63 nt, Homo sapiens
aggugaggggcacccagccccagccccaggggcgucucagggagcgggcugagccuggcuguc

SEQ ID NO: 756 - RNA, 61 nt, Homo sapiens
aggugauccucccaccucagcuuccagauuagcuggugcuauaggcaugcaccaccacguc

SEQ ID NO: 757 - RNA, 61 nt, Homo sapiens
aggugcacuugacaguauugaggucauuuguuauggugcuauuucaauuagucuagguuua

SEQ ID NO: 758 - RNA, 63 nt, Homo sapiens
agguggcugggaggguuuccaggcccccugccccuuccccacaaacugggugauagggcggac

SEQ ID NO: 759 - RNA, 63 nt, Homo sapiens
aggugguuuagggauuuuggcccuaaccaauacauugaauguaugaugacuauuugggaggac

SEQ ID NO: 760 - RNA, 61 nt, Homo sapiens
agguuaauguuggaaacacaaucagguguggauuggugcuacuuugaacaaaagguccccc

SEQ ID NO: 761 - RNA, 62 nt, Homo sapiens
agguuauacauuucaacagaacagggauccuuggcuacuguagaagcaguccuguauggaga

SEQ ID NO: 762 - RNA, 63 nt, Homo sapiens
agguucaucuguccaugcaguccucuuggauucucugaauguaguaacuaugaagcuaugcca

SEQ ID NO: 763 - RNA, 62 nt, Homo sapiens
agguuccuguaggugagacauauucuccauaaagcuacuguaguagaauucauucugggcaa

SEQ ID NO: 764 - RNA, 62 nt, Homo sapiens
agguuggcauucaauaaggaaaaaguucuaacuccaguauuaaauuguacauaaaucccaaa

SEQ ID NO: 765 - RNA, 63 nt, Homo sapiens
agguuggcucuggccucaguacccucagucuccucuccccacauuguguccuguggggguggg

SEQ ID NO: 766 - RNA, 62 nt, Homo sapiens
agguugguuacuauaauaccccucaguaagauuccaguauuaauuucugggcaguuuguucu

SEQ ID NO: 767 - RNA, 62 nt, Homo sapiens
aguaaaguaaacauuaucgcuaaguguacuugugcaguauuaacagcuacauuauacaguaa

SEQ ID NO: 768 - RNA, 63 nt, Homo sapiens
aguaagaaacuguccgauaugaaucacaacgugggugaauguaguauuuuccugaagugugag

SEQ ID NO: 769 - RNA, 62 nt, Homo sapiens
aguaauaauuuuuuaagauucacuauaugugauaguaugauaugcauuuauuuaaaaugcau

SEQ ID NO: 770 - RNA, 63 nt, Homo sapiens
aguaauguguucccuuucccaccccuugccugacccucagggagucagccugcuuccauccau

SEQ ID NO: 771 - RNA, 62 nt, Homo sapiens
aguacccaauggcaucucuccaucuacaaaguugcaguauuaugcaaauaaaacugaccuca

SEQ ID NO: 772 - RNA, 62 nt, Homo sapiens
aguacuuugcugagugaaaucaccauauagaauucaguauuaacagaucaugcauucagaug

SEQ ID NO: 773 - RNA, 62 nt, Homo sapiens
aguagaauauggacuuggaaaauucucuuaaucacuacuguauguaauauuuacauaaagac

SEQ ID NO: 774 - RNA, 61 nt, Homo sapiens
aguagaggccuuucugacucuuaauauucacuuuggugcuacuacccccauuaccugaggg

SEQ ID NO: 775 - RNA, 62 nt, Homo sapiens
aguagccaugcuuugguuguguguuuggccuuuucaguauuagacaaucauucuacaagagc

SEQ ID NO: 776 - RNA, 62 nt, Homo sapiens
aguaguuuuucuaugcuauuuguuguuguauaagcuacuguaagaaacuuaucauaaggaaa

SEQ ID NO: 777 - RNA, 62 nt, Homo sapiens
aguauuauccacuggucagauggucaacuuuuuucaguauuauuuauaguuggcacuugauu

SEQ ID NO: 778 - RNA, 63 nt, Homo sapiens
aguauucaaugcuuagaauacuaaaagguuuucuuugaauguauauguuucugaaagucauuu

SEQ ID NO: 779 - RNA, 63 nt, Homo sapiens
agucaaaagacacuuuccucuguuccauuccccaucucagggacuccugaauauucagccucu

SEQ ID NO: 780 - RNA, 62 nt, Homo sapiens
agucaaugagagggaaccaacauuugcuaagucucuacuguaugccagggaucaugcuuggc

SEQ ID NO: 781 - RNA, 64 nt, Homo sapiens
agucaauugguuuuccuuacaacaaaauaaaguaaaauguagcagucucggggcuuggcuuaug

SEQ ID NO: 782 - RNA, 62 nt, Homo sapiens
aguccaggcaacugacaugcuuuuauuagucauacaguauuaaugcaggugucaggaaaugu

SEQ ID NO: 783 - RNA, 64 nt, Homo sapiens
aguccccugggggaaucuggcauaauucggcuauaaauguagcaaugcuuggaaagguagucau

SEQ ID NO: 784 - RNA, 64 nt, Homo sapiens
agucgcuccuuaccgugacuccugcccuuggagggcauguagcagugucuguccugccaguccc

SEQ ID NO: 785 - RNA, 63 nt, Homo sapiens
agucuaauauuuccauggaaugugauuuggaguguuccccacacccuggaccucucccuagug

SEQ ID NO: 786 - RNA, 63 nt, Homo sapiens
agucugagggcugcacccggguauggugaguuccccucagggauugugcugagcgccuuggcc

SEQ ID NO: 787 - RNA, 63 nt, Homo sapiens
agucugggggaggguccccaccuuccuguaccuccuccccacagcuugcuuuuguuguaccgu

SEQ ID NO: 788 - RNA, 62 nt, Homo sapiens
agucuuuucaguuaucuucuaccuccuguauuuucuacuguaauaauguaauuuaaggccuu

SEQ ID NO: 789 - RNA, 62 nt, Homo sapiens
agugaaaacauuuagggacacccaaagaaugaugcaguauuaaaggggugguagaagcugcu

SEQ ID NO: 790 - RNA, 62 nt, Homo sapiens
agugaaaugcaaaaauauucccguuaucuuugaccaguauuaauuuuugagaucuuacugcu

SEQ ID NO: 791 - RNA, 63 nt, Homo sapiens
agugaagacaccugguagaugccacccuagucaaauccccacagcucgcaucgccaggggaca

SEQ ID NO: 792 - RNA, 62 nt, Homo sapiens
agugaccguacauuccugcucucggacuugaacucuacuguaacuguuuucuuaaaggaaau

SEQ ID NO: 793 - RNA, 63 nt, Homo sapiens
agugaugacugcuuguagguaugucugugccauuucucagggaaguaagauguaaauugaaga

SEQ ID NO: 794 - RNA, 61 nt, Homo sapiens
agugaugagcugagucagggauagggaguccccuggugcuaaccgugaacguagagacuug

SEQ ID NO: 795 - RNA, 63 nt, Homo sapiens
agugccucugcacaccgcccauuccacuuccuccuuccccacagggcagguggggaagcaguu

SEQ ID NO: 796 - RNA, 63 nt, Homo sapiens
agugcuacauuuucccucugagguccauagagauuugaauguauaggagauuauccgaaaaca

SEQ ID NO: 797 - RNA, 63 nt, Homo sapiens
agugcuggaggaaccacgcuuccuaacugcugcuucucagggaauccgacaccagccaaccau

SEQ ID NO: 798 - RNA, 63 nt, Homo sapiens
aguggaaaccaguauuaacccagagguuugggcaacucagggaagaaguggccggacuauaac

SEQ ID NO: 799 - RNA, 63 nt, Homo sapiens
aguggaggccccacucccaguugggcgucccggagcucagggacugagccccaagacgccucu

SEQ ID NO: 800 - RNA, 52 nt, Homo sapiens
aguggguauuaaaaaauaauuuucuccccacauggugggccuuugagguucc

SEQ ID NO: 801 - RNA, 63 nt, Homo sapiens
agugugagggugcucgcccguacucucagcugccucucagggacugcacuguuccucuucacc

SEQ ID NO: 802 - RNA, 62 nt, Homo sapiens
aguguggaugcaugugcgucaccguccacuccuccuacuguauuuuauuggacaggucagac

SEQ ID NO: 803 - RNA, 63 nt, Homo sapiens
agugugggcugugcccuagccacaccacagccagccucagggagccacggcccgucuagucga

SEQ ID NO: 804 - RNA, 64 nt, Homo sapiens
aguguguaaauguugacaaggaauuggaucacaaucauguagcagaauggcacccagaccacug

SEQ ID NO: 805 - RNA, 63 nt, Homo sapiens
aguguuaacuugguuguuccagagguaaaccaggucucagggaagagccuggagcugcuauug

SEQ ID NO: 806 - RNA, 63 nt, Homo sapiens
aguguuguuuuuguaucaauauguuugugcagugaugaauguauuuauuucucagacuugggg

SEQ ID NO: 807 - RNA, 62 nt, Homo sapiens
aguuaaaagcccauugccauuugguguggauuuucuacuguaagaagagccauagcugauca

SEQ ID NO: 808 - RNA, 62 nt, Homo sapiens
aguuauuccauggaaauacaaugcuuuccaccuacuacuguaguucaauaacguuuccaccu

SEQ ID NO: 809 - RNA, 63 nt, Homo sapiens
aguucauuucacugggauuuugaagcauuucugucugaauguaaagccuguucuaguccuggu

SEQ ID NO: 810 - RNA, 61 nt, Homo sapiens
aguuccuccggaauaacagucccacuguuaaccuggugcuacugggaaguuccacacagua

SEQ ID NO: 811 - RNA, 61 nt, Homo sapiens
aguucuguugaacagggacucaccuacgagugguggugcuaucagcugagacgggaagcag

SEQ ID NO: 812 - RNA, 61 nt, Homo sapiens
aguugcaggaggagagguggauggcaaugugauuggugcuauaacucaggcagccugggag

SEQ ID NO: 813 - RNA, 63 nt, Homo sapiens
aguuggggugaggccugggcagccggagggcagggcucagggagcaggaggcugcauccgucc

SEQ ID NO: 814 - RNA, 63 nt, Homo sapiens
aguuguaagcccuuaaaagcgucaggaauugcucacucagggaacucgguuuuuggagacaug

SEQ ID NO: 815 - RNA, 63 nt, Homo sapiens
aguuguugauuagacaccgaaagguuacugauuguugaauguaucuguguuagagcugugcac

SEQ ID NO: 816 - RNA, 61 nt, Homo sapiens
aguuuaucuuuaccucagugcaggcuuaaauaauggugcuaauacugguagauauauacug

SEQ ID NO: 817 - RNA, 64 nt, Homo sapiens
aguuuauuaaugauaccuuaaauuacucaggacuuaauguagcauugcacuucuguguacagua

SEQ ID NO: 818 - RNA, 63 nt, Homo sapiens
aguuuauuucugcaaaugaugagccaacuaguuauugaauguaaaccagauggcaaaacacuu

SEQ ID NO: 819 - RNA, 62 nt, Homo sapiens
aguuucaagcaacuccaaaauugaaugugacaaacaguauuaaaccuuaagccucaagacgu

SEQ ID NO: 820 - RNA, 63 nt, Homo sapiens
aguuucuucaucagcagaauggguuucuggccucucucagggauaauuuugaaggcauaauga

SEQ ID NO: 821 - RNA, 63 nt, Homo sapiens
gggugacuuucauuccaguugcugggacggaaggcugaauguagggucauuuuguaugggaua

SEQ ID NO: 822 - RNA, 64 nt, Homo sapiens
ggguggaaccuguuugauccaugauuauaucauguuauguagcaaaaggaagacugucuggggg

SEQ ID NO: 823 - RNA, 61 nt, Homo sapiens
ggguggggggaaagaaacuauuaucugacacacuggugcuauuaauuauuucaaauuuaua

SEQ ID NO: 824 - RNA, 61 nt, Homo sapiens
ggguggggguugggugggagggacuugggucuuuggugcuaggagagggccugugcuccac

SEQ ID NO: 825 - RNA, 61 nt, Homo sapiens
gggugugaccucaucuuucucauggugcuauccuggugcuauugggguggggagcucccuc

SEQ ID NO: 826 - RNA, 62 nt, Homo sapiens
gggugugauuucuauaccaaagauaugcuuauuucaguauuagaaaaauauucuucuuacau

SEQ ID NO: 827 - RNA, 64 nt, Homo sapiens
gggugugucagcguggcagccacguggaagcagggcauguagcaggccaggccacgggcuugca

SEQ ID NO: 828 - RNA, 62 nt, Homo sapiens
ggguguuuaugacacuaaagucacauacaagcuaguaugauacauacaucauagaaagcuua

SEQ ID NO: 829 - RNA, 62 nt, Homo sapiens
ggguuaaaaauuaucaguuuaaucucuuuaagaacaguauuaucagaguuuaaaaugaguua

SEQ ID NO: 830 - RNA, 63 nt, Homo sapiens
ggguuacuaaccuugaaauguaagagaucugguuuugaauguaaaaguugcaacacacaaacg

SEQ ID NO: 831 - RNA, 63 nt, Homo sapiens
ggguucacacaaaaagcaaacuacauucuggucugcucagggagaagcuugccuuugaacugg

SEQ ID NO: 832 - RNA, 62 nt, Homo sapiens
ggguuccugcaccuggaauccaguguguccaagccaguauuaaauuaucucaacacugaccc

SEQ ID NO: 833 - RNA, 63 nt, Homo sapiens
ggguuuggaccauuccccccacucccuacccuuaauccccacaugggaagaagcuaucaucac

SEQ ID NO: 834 - RNA, 62 nt, Homo sapiens
ggguuuugcuuuagagugcaaguaucauaauuccguaugauagauggggccuggacacccau

SEQ ID NO: 835 - RNA, 63 nt, Homo sapiens
ggguuuuuuaguugaauuuuuuuuaacauuccucaugaauguaaauuuguacuauuuaacuga

SEQ ID NO: 836 - RNA, 63 nt, Homo sapiens
gguaaauuuuaaacucuguccauguucuguuagaacucagggacaaggauccaugaaaaagac

SEQ ID NO: 837 - RNA, 64 nt, Homo sapiens
gguaagcaugcacaguuugcagucuacaguuuuuuuauguagcacaaaauagguguaccuuuau

SEQ ID NO: 838 - RNA, 63 nt, Homo sapiens
gguaagucaugucuuccauaugacauuucuacucauccccacacugccuuccacuuaaccugu

SEQ ID NO: 839 - RNA, 63 nt, Homo sapiens
gguaaucauuccagguguguucaguaguuccaggacucagggacucaggccagucacccugug

SEQ ID NO: 840 - RNA, 62 nt, Homo sapiens
gguacaaauuacugguauguuuuauaagccgcagcuacuguacacagccuaucugauauaau

SEQ ID NO: 841 - RNA, 63 nt, Homo sapiens
gguagaaauucucccuguaugccuagaaggaucagugaauguaagagccuuggaaauuaacaa

SEQ ID NO: 842 - RNA, 62 nt, Homo sapiens
gguauucugggaaugauguaaugcucugaauuuaguaugauauaaagaaaacuuuuuugugc

SEQ ID NO: 843 - RNA, 61 nt, Homo sapiens
gguauuuuaggccaagugugcacccacauccaauggugcuacaagugacugaaauaauauu

SEQ ID NO: 844 - RNA, 62 nt, Homo sapiens
gguauuuucacugaacaaggucaauugguuaccucaguauuacagccaauauaguccaaggg

SEQ ID NO: 845 - RNA, 61 nt, Homo sapiens
ggucaaaagcugccccacccacucucccucacauggugcuaggcugggagcugcccugaga

SEQ ID NO: 846 - RNA, 63 nt, Homo sapiens
ggucagggucuucuugcgacccggcccgcuccagauccccacagcucucggccgcggacccgg

SEQ ID NO: 847 - RNA, 63 nt, Homo sapiens
ggucauguauguaggcuguuaccucaagugagucacucagggaacaaugagcacuugaagauu

SEQ ID NO: 848 - RNA, 64 nt, Homo sapiens
gguccaucuugucucaggagaagaaaccuuucuccaauguagcagaauuauccucuucccugua

SEQ ID NO: 849 - RNA, 61 nt, Homo sapiens
ggucccacagacuguggccaugaggcugcaggcuggugcuaugacagcagauugcagcaca

SEQ ID NO: 850 - RNA, 63 nt, Homo sapiens
gguccuuuucugaugguggcuggggcuggggugagcucagggaggggaagaggagaauacaug

SEQ ID NO: 851 - RNA, 64 nt, Homo sapiens
ggucgguccucccugccaaccuuccccagcuccaauauguagcagucucucuggauggcggaga

SEQ ID NO: 852 - RNA, 61 nt, Homo sapiens
ggucucaaaaaaggcuggaguacaguaguacaguggugcuaucucagcuuacugcagccuc

SEQ ID NO: 853 - RNA, 62 nt, Homo sapiens
ggucuggagggacagagaacaguucccugauuaacaguauuaauagcgacauugguaacagc

SEQ ID NO: 854 - RNA, 63 nt, Homo sapiens
ggucuuaucagacgcccgucuuaaaguccagcaugcucagggacccuguguaggaucucguuu

SEQ ID NO: 855 - RNA, 64 nt, Homo sapiens
ggucuuccccuucccaucaacucuuucugcuugacaauguagcaacccaggccccccacccacg

SEQ ID NO: 856 - RNA, 63 nt, Homo sapiens
ggucuuggccacagccugagugacgaauuuccuacugaauguaccaaguuccaauuuuuaagg

SEQ ID NO: 857 - RNA, 63 nt, Homo sapiens
ggucuuuuauuuguacccaugugucugucacaccaugaauguaccuggggaaaucaacugacc

SEQ ID NO: 858 - RNA, 63 nt, Homo sapiens
ggugaaaagguacaauagugcuugucuccgauagcuccccacaucucuaauugacuuccacaa

SEQ ID NO: 859 - RNA, 63 nt, Homo sapiens
ggugaagggguaggaggagggcccucagcuggcccuccccacacacaggacggcaggggcacu

SEQ ID NO: 860 - RNA, 64 nt, Homo sapiens
ggugaaucugaacguacaucucacugguauaauuauauguagcacugugcuguguagauaguuc

SEQ ID NO: 861 - RNA, 63 nt, Homo sapiens
ggugacucacaaacuucuuggaaagagacccugugugaauguaaaugcugucauuaugacuuu

SEQ ID NO: 862 - RNA, 63 nt, Homo sapiens
ggugauaauuuugcuuuguguuacuuuuuugcucuugaauguaucguuaugauggucucuuau

SEQ ID NO: 863 - RNA, 63 nt, Homo sapiens
ggugccagcuucgccaugccuggacccagacugaauccccacacccuuccugggaaacagaua

SEQ ID NO: 864 - RNA, 63 nt, Homo sapiens
gguggagggcucaaggggcucuaagagggaaaagcuccccacacccccagaugcugcuccucc

SEQ ID NO: 865 - RNA, 63 nt, Homo sapiens
gguggagggggaagccugaccuuggccaccuccccuccccacagccuuccucacccuuggcug

SEQ ID NO: 866 - RNA, 63 nt, Homo sapiens
ggugggaagguuuugcugcuaauguauuuauggaaugaauguauuucauucaaaucuguauuc

SEQ ID NO: 867 - RNA, 63 nt, Homo sapiens
ggugggacuuuaccggaaccacagggauguuuuacugaauguaccucuuuccuuauagaaguu

SEQ ID NO: 868 - RNA, 64 nt, Homo sapiens
gguggugacuaaauauacagucauugaauaaauaccauguagcaaguguacuuuguggaguguu

SEQ ID NO: 869 - RNA, 62 nt, Homo sapiens
ggugguuugguuucagagccagugcuuuuccccucuacuguacugccucucaaccaacacag

SEQ ID NO: 870 - RNA, 63 nt, Homo sapiens
gguguagcuccuacuuuugcacaggcaccagcuaccucagggacauggcacgggcaccugcuc

SEQ ID NO: 871 - RNA, 63 nt, Homo sapiens
ggugucugccccgcguuuccugccugcggaccagaugaauguagcagauccccagccucuggc

SEQ ID NO: 872 - RNA, 61 nt, Homo sapiens
ggugugcuuucuugagcccucauaaggaaguacuggugcuagguuuugcaagauuuuguau

SEQ ID NO: 873 - RNA, 63 nt, Homo sapiens
gguuaaaucucacugcaaacaugaaaauuagaaaaugaauguaaugaaauuuugcaguauaca

SEQ ID NO: 874 - RNA, 63 nt, Homo sapiens
gguuacucagcucccuggaaagcaggcaagcauguugaauguaucuaguggucugauuuuaau

SEQ ID NO: 875 - RNA, 63 nt, Homo sapiens
gguuaggagacuaaaauauaaauuaaguugugauuugaauguagauugguaucaccuccaacu

SEQ ID NO: 876 - RNA, 63 nt, Homo sapiens
gguuauccuuacuugaguccauauggguuggacaguccccacacacauuaaauucuguaaaug

SEQ ID NO: 877 - RNA, 62 nt, Homo sapiens
gguuauuauaaauauuuaggcuugaagcauagagcuacuguagggugaaaaaucucuguagg

SEQ ID NO: 878 - RNA, 63 nt, Homo sapiens
gguuauuucucauacucugucccucucuuuuucauugaauguaagaguacauuuuaauguugc

SEQ ID NO: 879 - RNA, 61 nt, Homo sapiens
gguucaaaacuggcuuuuccucugggccuggguuggugcuauaggccaagggucauuuuau

SEQ ID NO: 880 - RNA, 63 nt, Homo sapiens
gguuggacagcguuggucuauacugacucuuauuucucagggagaucacagcaaccuaaauaa

SEQ ID NO: 881 - RNA, 64 nt, Homo sapiens
gguugguugagguggaagcccuccuuccacggauccauguagcaggacugaauuguccccaguu

SEQ ID NO: 882 - RNA, 63 nt, Homo sapiens
gguuugaugaaguuacuauucaauaaaagaaaccucucagggaagucuccagacgcccaucug

SEQ ID NO: 883 - RNA, 64 nt, Homo sapiens
gguuuggauuauugauauggacagauucccaccuguauguagcacgccaugcugggccagcagu

SEQ ID NO: 884 - RNA, 64 nt, Homo sapiens
gguuuuaaauguggaaucauugacagaaaugucuuuauguagcauauggcuguguaucacuagu

SEQ ID NO: 885 - RNA, 63 nt, Homo sapiens
guaaaauggcugagcauugcagagaaaaaaaaaaguccccacauuuuauuuuuuaaaaaccau

SEQ ID NO: 886 - RNA, 64 nt, Homo sapiens
guaaagggucuuccugaagauguggauucuaucuuuauguagcaagaaaucuacauccaccaaa

SEQ ID NO: 887 - RNA, 63 nt, Homo sapiens
guaaauucacagcaguaagauaauauaaauuuuguugaauguauuaacaucauauggucugaa

SEQ ID NO: 888 - RNA, 62 nt, Homo sapiens
guaacaaagagaaaugugcaaauauuuuuuaaggcaguauuaagugcaagaggaguaacaug

SEQ ID NO: 889 - RNA, 61 nt, Homo sapiens
guaacaaauauaagguuuacgagcuaugagaauuggugcuaucaccauuagcuauuugcug

SEQ ID NO: 890 - RNA, 61 nt, Homo sapiens
guaaccggauggaauucugguauuuauaggcauuggugcuagaugguacauuuuauguguu

SEQ ID NO: 891 - RNA, 63 nt, Homo sapiens
guaacuagaacaguuaucacuggaacuaagaauuuuccccacagaggugaacagaccaagaac

SEQ ID NO: 892 - RNA, 62 nt, Homo sapiens
guaacuaguguuaaagauuuuuaucuuugccugucuacuguaacuuaagacuuucauagaau

SEQ ID NO: 893 - RNA, 61 nt, Homo sapiens
guaacuucagguuggauccuguguggaugaucuuggugcuaagcagaaaagaaauuuggac

SEQ ID NO: 894 - RNA, 63 nt, Homo sapiens
guaaggaugggaauauuuuguuauacuguguauagugaauguauuguacugugucugugaaaa

SEQ ID NO: 895 - RNA, 62 nt, Homo sapiens
guaagugcuccacuuuagagauguaccuuaauuacuacuguauuugcaaauuaagggaaauu

SEQ ID NO: 896 - RNA, 63 nt, Homo sapiens
guaauggucuuuuauuguagaauugguucuuuauacucagggaaguaauuauauuguuuuuac

SEQ ID NO: 897 - RNA, 64 nt, Homo sapiens
guacaggaaauauugcccaaugacuaguccucauccauguagcaccacuaauucuuccaugccu

SEQ ID NO: 898 - RNA, 63 nt, Homo sapiens
guacaugaaaggauucacucuggagagaagucauaugaauguaagaaauguagaaaagcauug

SEQ ID NO: 899 - RNA, 61 nt, Homo sapiens
guaccuaaagauguauucauuuguaacauauguuggugcuagaguuuugcugguaauucag

SEQ ID NO: 900 - RNA, 61 nt, Homo sapiens
guaccuccuuuagcaccuuagugcaauucauuguggugcuauuuguuuuuaccugaauguu

SEQ ID NO: 901 - RNA, 62 nt, Homo sapiens
guacucuguaaaaguuuugcagacaaaauagaaaguaugauaauccgucagaaguaugaugu

SEQ ID NO: 902 - RNA, 63 nt, Homo sapiens
guacugacccucgucugucccuuccccuucaccgcuccccacagcuuugcaccccuuuccucc

SEQ ID NO: 903 - RNA, 61 nt, Homo sapiens
guacuggacgugcucagggucuagggucacagauggugcuauuaauugaacuggaacacag

SEQ ID NO: 904 - RNA, 62 nt, Homo sapiens
guacuuaguugaaacaaaaaggaauuuuaguagacaguauuauauuaucuuugaaaaucaag

SEQ ID NO: 905 - RNA, 62 nt, Homo sapiens
guacuuaguugaaacaaaaaggaguuuuaguagacaguauuauacuacauuugaaaaucaag

SEQ ID NO: 906 - RNA, 63 nt, Homo sapiens
guacuucagaaggaugacuacuuuuucucucauuaugaauguaaaacuaaauacaauugaguu

SEQ ID NO: 907 - RNA, 64 nt, Homo sapiens
guagaaauauucauaaaguuaacucacaugacccaaauguagcaaguuuccuaagguacaauag

SEQ ID NO: 908 - RNA, 62 nt, Homo sapiens
guagaagagucaccagcagguuccaaauugauguguaugauaggaaaaaaaccuuaauuuua

SEQ ID NO: 909 - RNA, 63 nt, Homo sapiens
guagaauccauguaguucccaccaguugccuuccccucagggauggaaggaagaggguuucuu

SEQ ID NO: 910 - RNA, 64 nt, Homo sapiens
guagaauguguacauaccacagugcuguaauuuuguauguagcaaucauguaaauacauguaug

SEQ ID NO: 911 - RNA, 63 nt, Homo sapiens
guagaccugaccuuguuauuuauuagauaacauuuugaauguauccauuggauuucuaaaaug

SEQ ID NO: 912 - RNA, 63 nt, Homo sapiens
guagagagccuaaagagaguuguuucugagcugaucucagggaaauacaaauaacuugggaga

SEQ ID NO: 913 - RNA, 62 nt, Homo sapiens
guagagggcugugacaacagacuuggaagguuugcuacuguauauacugccauugagaaggg

SEQ ID NO: 914 - RNA, 63 nt, Homo sapiens
guagcacugacuggaguuugcugccuacagaguuuugaauguacuaguccuuaguuuccauag

SEQ ID NO: 915 - RNA, 63 nt, Homo sapiens
guagcaugauguauuuaaaguaaggccuuuaguaaugaauguaaugagagaaaauguuuugaa

SEQ ID NO: 916 - RNA, 63 nt, Homo sapiens
guagcuacacaguaaguagcuugguagauaguuauugaauguauuuauguaguguauuaagaa

SEQ ID NO: 917 - RNA, 63 nt, Homo sapiens
guagcugguuuaugugacgugcagaugagaugaagcucagggauaacccauaugacaaugacu

SEQ ID NO: 918 - RNA, 63 nt, Homo sapiens
guaguacauuguaccaaaguucuuaauaagaauauuccccacaauccuguucucuaaauguca

SEQ ID NO: 919 - RNA, 63 nt, Homo sapiens
guaguauaauuuguuacuuucaaauacccguacuuugaauguagguuuuuuuguuguuguuau

SEQ ID NO: 920 - RNA, 63 nt, Homo sapiens
guaguucacacuggaaaaaggccacguaugugccuugaauguagccaaaaugacgaacaacac

SEQ ID NO: 921 - RNA, 62 nt, Homo sapiens
guauaauuauuuauuuguaaauuauauacauguacuacuguacuaaaauauuauguacauua

SEQ ID NO: 922 - RNA, 61 nt, Homo sapiens
guauaccuuugugauuuucuaaugaguuuuccauggugcuacaaauaauccagacuaccag

SEQ ID NO: 923 - RNA, 62 nt, Homo sapiens
guauagaguuuacuuuguacacguuugaaaccaacuacuguagaagaugaggaaucuauugu

SEQ ID NO: 924 - RNA, 62 nt, Homo sapiens
guauaguaguuaucuuaaaauauacacuccuaagcaguauuauuuuaaaauccuuuacccug

SEQ ID NO: 925 - RNA, 64 nt, Homo sapiens
guauaguuuuugcaaauagagcuguauacuguuuaaauguagcaggugaacugaacugggguuu

SEQ ID NO: 926 - RNA, 63 nt, Homo sapiens
guaucgcuaguaaaauagcaugcuggacuucagaccucagggauccuuuugaugcacugacca

SEQ ID NO: 927 - RNA, 61 nt, Homo sapiens
guaucuaguuguauuauucauagaaaaucaaucuggugcuaaugguuggcccugguguugu

SEQ ID NO: 928 - RNA, 62 nt, Homo sapiens
guauguacagucuacuuuugaacuauuuuuaucacaguauuauuuauugcuuucuuucaaua

SEQ ID NO: 929 - RNA, 63 nt, Homo sapiens
guaugucacaguccguguuccacccagccuuguuauccccacauucuuucaagauaggaguca

SEQ ID NO: 930 - RNA, 63 nt, Homo sapiens
guaugucauucuggauaaauccccaagccccuuuaugaauguagugaaauacauggcaugugg

SEQ ID NO: 931 - RNA, 64 nt, Homo sapiens
guauuaguucucauuauugaacugucugugcacuguauguagcaagcauuuuucaucuguugua

SEQ ID NO: 932 - RNA, 62 nt, Homo sapiens
guauuauaaauuguugugaauuugaagaauccgucuacuguauuauugcuaaauauuuuguu

SEQ ID NO: 933 - RNA, 63 nt, Homo sapiens
guauuaugucuuuauuguuguuaaaaaguuuuuauugaauguaugaaaauuaucaaauuguau

SEQ ID NO: 934 - RNA, 64 nt, Homo sapiens
guauucaccacaguagggugacuauagcaaauaauaauguagcauguauuucaagauagcuaga

SEQ ID NO: 935 - RNA, 63 nt, Homo sapiens
guauucucuccauagaacagcacuaccuuccucucuccccacaugugacuacugagggcaguu

SEQ ID NO: 936 - RNA, 61 nt, Homo sapiens
guauuguauuaaaaugagacuauuggaaggaaauggugcuaaaacuaauaacaucucuuac

SEQ ID NO: 937 - RNA, 63 nt, Homo sapiens
guauuucuacagaaaaauggcauagaagucaguauugaauguauuaaauuggcuuucuucuuc

SEQ ID NO: 938 - RNA, 62 nt, Homo sapiens
gucaaaucagaugaaguuauaguuaggauucuaacuacuguaaaagauuuuugcuucccucu

SEQ ID NO: 939 - RNA, 61 nt, Homo sapiens
gucaagacauuucucuaacuccugccauucuucuggugcuacuccaugcaggggucagugc

SEQ ID NO: 940 - RNA, 63 nt, Homo sapiens
gucacggcccagacugggcaccuucgcgucucagccucagggagccccacagccccaagcucg

SEQ ID NO: 941 - RNA, 64 nt, Homo sapiens
gucacugaggguuuugguuggcaucguuguuuuugaauguagcacaagcgaugagcaaacucua

SEQ ID NO: 942 - RNA, 63 nt, Homo sapiens
gucagagcuagggugggggugcccgauucgggugcugaauguaaggaggggagccuccaagug

SEQ ID NO: 943 - RNA, 61 nt, Homo sapiens
gucagaucagcaucaggcuguuaucaagucuguuggugcuaaaaaguaaaagaugaaaugu

SEQ ID NO: 944 - RNA, 63 nt, Homo sapiens
gucagcuugaugaauaucgagcagaaguugaucaacucagggaaacacuggaaaaaauucaag

SEQ ID NO: 945 - RNA, 62 nt, Homo sapiens
gucaguauuuuuccagcauuuaaauugaaacggucaguauuagaccacugcuagguuaugua

SEQ ID NO: 946 - RNA, 63 nt, Homo sapiens
gucauugcagcucucagcaaacugggucauagcuuuccccacagcucagccuggggccugggc

SEQ ID NO: 947 - RNA, 63 nt, Homo sapiens
gucccagccaggaucccccuggaagaaaaagggcguccccacacucuaggugauaggacuuac

SEQ ID NO: 948 - RNA, 63 nt, Homo sapiens
gucccauccccacguccccucaucccgucaccucguccccacauccccuugccccgucaccuc

SEQ ID NO: 949 - RNA, 64 nt, Homo sapiens
guccccuucaaguguuguuucuccaaguagucauaaauguagcaaguauaaaucagaauaucau

SEQ ID NO: 950 - RNA, 63 nt, Homo sapiens
gucccucuguaauuucaaaaugaaugaaauucaugugaauguagguugagagggcacugaaga

SEQ ID NO: 951 - RNA, 62 nt, Homo sapiens
gucccugagguaucugagcguuuaaaguacugagcaguauuagcggaucccgcguaguguca

SEQ ID NO: 952 - RNA, 63 nt, Homo sapiens
gucccugcagcagcuggggccucuggucaggaacccucagggacccaggaacucagcuuccaa

SEQ ID NO: 953 - RNA, 62 nt, Homo sapiens
guccgauccuaaccguguaugcacccuacagcagcaguauuacucacuagccacagaauacc

SEQ ID NO: 954 - RNA, 63 nt, Homo sapiens
guccuugugacuucaacggacucuuccaaauuguaugaauguaucaauguauuagauaaaccc

SEQ ID NO: 955 - RNA, 63 nt, Homo sapiens
gucgcccaacuagaguguaguggcacaaucucggcuccccacaaccucugacuccaggguuca

SEQ ID NO: 956 - RNA, 55 nt, Homo sapiens
gucuacccaucgcgacugacccagacccucagggagucagggcacgggaggcccu

SEQ ID NO: 957 - RNA, 63 nt, Homo sapiens
gucuacccaucgcgacugacccagacccucagggagucagggcacgggaggcccuaucuccca

SEQ ID NO: 958 - RNA, 63 nt, Homo sapiens
gucuaggugagagcaggccccucuccccacaccucgccccacagagcucuguucuuagccucc

SEQ ID NO: 959 - RNA, 62 nt, Homo sapiens
gucuauaaagaagauauaaaauugugacuuuauucuacuguaagcaauaauuugcuugcaau

SEQ ID NO: 960 - RNA, 62 nt, Homo sapiens
gucucaaaugucucguaucaguuuuaguguuuuucaguauuagggaaagguaauauaaaaac

SEQ ID NO: 961 - RNA, 63 nt, Homo sapiens
gucucuaggucuguucuucuucccuagcauccuccuccccacaucuccuuucacccucuuggc

SEQ ID NO: 962 - RNA, 63 nt, Homo sapiens
gucugccaguaacauguucccauguacagacacgguccccacacccucccagccucaggccca

SEQ ID NO: 963 - RNA, 61 nt, Homo sapiens
gucugcuuuagcacgcacgcuccgaaugacuccuggugcuaggccaugcuggcugcuguca

SEQ ID NO: 964 - RNA, 63 nt, Homo sapiens
gucugggucauucaggcaguacaucugaauuaagcugaauguagacaaauaaagaaaaacaaa

SEQ ID NO: 965 - RNA, 62 nt, Homo sapiens
gucuuacuccuuuguuaguuuuguuucugcacaacuacuguacuuuuccauauggaauaaag

SEQ ID NO: 966 - RNA, 62 nt, Homo sapiens
gucuuauggauaagguacaugaagauuuuugcagcaguauuagugguucaguggcugcacuu

SEQ ID NO: 967 - RNA, 64 nt, Homo sapiens
gucuuguccuccuguuacuugcuucugcuguacaagauguagcaccuuuucuccucuuugaaca

SEQ ID NO: 968 - RNA, 61 nt, Homo sapiens
gucuugugcuggucuguuaaauccugcccuccuuggugcuagauccaguugugccucaggg

SEQ ID NO: 969 - RNA, 63 nt, Homo sapiens
gucuuuccucggccgagucaggcuuccuggugagccucagggagugcauggucucagaugcca

SEQ ID NO: 970 - RNA, 63 nt, Homo sapiens
gucuuugucacuggggguggugggggaggcuggagcucagggacggggcacuccuggcagauu

SEQ ID NO: 971 - RNA, 63 nt, Homo sapiens
gugaaacccaggaccccaaaguucugcguaggugccucagggacuuuuggauuuggaaaguag

SEQ ID NO: 972 - RNA, 63 nt, Homo sapiens
gugaagaugaaugaauguaacuccuggugugaagaugaauguaaacccuggcgacaguugaga

SEQ ID NO: 973 - RNA, 63 nt, Homo sapiens
gugaaugaggagaacagucaggcagggagcccuucuccccacagagcuuucaggagcagacag

SEQ ID NO: 974 - RNA, 64 nt, Homo sapiens
gugaauguguguauguaugaaggccacaucaacuuuauguagcaaagggcuugguggccaagcc

SEQ ID NO: 975 - RNA, 63 nt, Homo sapiens
gugaccugguuaccuuggaaaugcaggaacuuauaugaauguacuauaaaauaaaaugcggac

SEQ ID NO: 976 - RNA, 63 nt, Homo sapiens
gugacggaggaaacagacauggggagggugaacaguccccacagcagacagcuacuugggcau

SEQ ID NO: 977 - RNA, 63 nt, Homo sapiens
gugacguucgugauguccugcccgccgggagucuuuccccacaccccagccaucgccgcccgc

SEQ ID NO: 978 - RNA, 64 nt, Homo sapiens
gugacuuuggaaagcaaagucaaaacccaguuuaggauguagcaccugccccaggauuccugcc

SEQ ID NO: 979 - RNA, 63 nt, Homo sapiens
gugagaguuaaacaaagcugagauaggauaugaaucucagggaggauaugaggacucauugau

SEQ ID NO: 980 - RNA, 63 nt, Homo sapiens
gugagcagacuuaaccccuccgugccucagcuuuuuccccacagacaccuaccucacaggggc

SEQ ID NO: 981 - RNA, 63 nt, Homo sapiens
gugagcaggucagcaggaacccuuuucugcagucacucagggacccagacuuacagagugggu

SEQ ID NO: 982 - RNA, 63 nt, Homo sapiens
gugaggagguggguggaggcaugcaggggagacgacucagggaucgcgggggcggggaggugg

SEQ ID NO: 983 - RNA, 63 nt, Homo sapiens
gugagggcucccacaggcaccagcaaaacaacggaugaauguagcccuuccaacaccugacag

SEQ ID NO: 984 - RNA, 63 nt, Homo sapiens
gugauucucuuuucuuaguggaguggaauguucuauccccacaagaaggauuauaucuuauag

SEQ ID NO: 985 - RNA, 63 nt, Homo sapiens
gugcacuaggaagugaaucccgcaggacagcugcacucagggauacgcccaacaccauggccu

SEQ ID NO: 986 - RNA, 61 nt, Homo sapiens
gugcauguacauagaauucuuucuguauucagauggugcuaauucagacuccagacugaau

SEQ ID NO: 987 - RNA, 63 nt, Homo sapiens
gugcauguugccuucauuccugagcagguaucauccucagggaaccagcauggcaccuaccag

SEQ ID NO: 988 - RNA, 63 nt, Homo sapiens
gugcccuugcggccuccuggcccggugcagcugcccucagggacagggugggugcucucagau

SEQ ID NO: 989 - RNA, 64 nt, Homo sapiens
gugccgucuuucauagcuggucucuguauaaagaguauguagcaacaacuguuuaacauccgag

SEQ ID NO: 990 - RNA, 63 nt, Homo sapiens
gugccuaugccugggggaggucaguaggggcccccuccccacauggcccucgcucugucuaug

SEQ ID NO: 991 - RNA, 64 nt, Homo sapiens
gugccuauuaccucagcauuucucacaaaguguaccauguagcauguuuuguguauauaaaagg

SEQ ID NO: 992 - RNA, 63 nt, Homo sapiens
gugccucucggcucagugacagccaaccugcccccuccccacaccaaucagccaggcugagcc

SEQ ID NO: 993 - RNA, 62 nt, Homo sapiens
gugcugagaauccuacccuuccuugcugucacuacaguauuaauauuuuacuguauuuucuu

SEQ ID NO: 994 - RNA, 63 nt, Homo sapiens
gugcugagauuacaggcgugagccaccacacccagcucagggaggcguaguuuucuuuaauuu

SEQ ID NO: 995 - RNA, 63 nt, Homo sapiens
gugcugguggacagugccccucccaccuuccuucuuccccacaacagaagagaccagcgacuc

SEQ ID NO: 996 - RNA, 62 nt, Homo sapiens
gugcuuaguugaaacaaaaaggaguuuuaguagacaguauuauacuaucuuugaaaaucaag

SEQ ID NO: 997 - RNA, 64 nt, Homo sapiens
gugcuugugccuugucccaaaauaaauccuuucagaauguagcacucacgcccuaauaaggagc

SEQ ID NO: 998 - RNA, 63 nt, Homo sapiens
guggagcugugguuugacagcgcuggcucugcuucuccccacacacuuacauggcaaagguaa

SEQ ID NO: 999 - RNA, 63 nt, Homo sapiens
guggaggcagagccccccaggacaggagcaacugucucagggaggacagaggaaaacaucaca

SEQ ID NO: 1000 - RNA, 64 nt, Homo sapiens
guggauauuugucacuugguuucagaaaguucacaaauguagcaacagcucacaugacugagua

SEQ ID NO: 1001 - RNA, 62 nt, Homo sapiens
guggcuuuucauggcccuucaaauuggaauggaacuacuguacuuugccauuuuucuauaaa

SEQ ID NO: 1002 - RNA, 63 nt, Homo sapiens
gugggaaaaauauugcuacaauuuuuuuuaaucucugaauguaauuucgauacuguguacaua

SEQ ID NO: 1003 - RNA, 63 nt, Homo sapiens
gugggcacucaccucagcagagccucaaugccaccuccccacaccacccaagccuagcugggu

SEQ ID NO: 1004 - RNA, 62 nt, Homo sapiens
guggggaaggugccuauuuuagagaacuuugucacaguauuaaaguucccggggcccacauc

SEQ ID NO: 1005 - RNA, 63 nt, Homo sapiens
gugggggucucuaaagagagacugucaugggucauuccccacaagagccacauccucacaccu

SEQ ID NO: 1006 - RNA, 63 nt, Homo sapiens
gugggugcuucuguugggcccaguggccccugcuauccccacagccucauuccugcagaaggu

SEQ ID NO: 1007 - RNA, 63 nt, Homo sapiens
guggguggacuuggaggaggaacggcaagggccgguccccacacucuugcuccuccugggcau

SEQ ID NO: 1008 - RNA, 63 nt, Homo sapiens
guggucuuccaaaaaaaauaggagcuugguugaaguccccacauuuucaagcacucaguguuc

SEQ ID NO: 1009 - RNA, 62 nt, Homo sapiens
guggugaauauaguaaauauacauucugguuacacuacuguaaacuuguauguagggugaug

SEQ ID NO: 1010 - RNA, 62 nt, Homo sapiens
gugguucagugagcugcacugaccucuacauuuuguaugauauguaaaacagauuuuuugua

SEQ ID NO: 1011 - RNA, 62 nt, Homo sapiens
gugguuccagagaaagagaggauaccucaggacaguaugauacaucuuaccuaaugguaagu

SEQ ID NO: 1012 - RNA, 64 nt, Homo sapiens
gugguuucaauucagcuugaaaaauaaucucacuacauguagcaguacauuauauguacauuau

SEQ ID NO: 1013 - RNA, 63 nt, Homo sapiens
gugucaugaguguuuaaaaucaagaggaagcugcaugaauguaaucaacauuccaacuggagc

SEQ ID NO: 1014 - RNA, 62 nt, Homo sapiens
gugucccuaacagugagguuccaucacaaaggggcaguauuaauuagcagcagcgugcagcu

SEQ ID NO: 1015 - RNA, 63 nt, Homo sapiens
gugucuuaaaacaaggcuuacuuacuagacauaacugaauguaaaaagugcuuuuucaaaucu

SEQ ID NO: 1016 - RNA, 61 nt, Homo sapiens
gugugaaaauguguuacuuuuaggacguguauuuggugcuacucucugugaccaccaaugg

SEQ ID NO: 1017 - RNA, 61 nt, Homo sapiens
gugugaauaaagguaauuuuauugaaucuucauuggugcuaaugauggacaguuaaaaaga

SEQ ID NO: 1018 - RNA, 63 nt, Homo sapiens
gugugaggcaugacccaaauuguaagcauagggaccucagggauggggaagaaacccgaguac

SEQ ID NO: 1019 - RNA, 63 nt, Homo sapiens
guguggaaugcugcugcaccugucccuucugcuggcucagggaagugucuucuugcccacauu

SEQ ID NO: 1020 - RNA, 63 nt, Homo sapiens
gugugugacuuugagcaaaaagugacuucuuuuugugaauguaaaauuugugaaacuugaguu

SEQ ID NO: 1021 - RNA, 63 nt, Homo sapiens
gugugugucuguauaaucaguuuucaguuaucuucugaauguagggaagccaugucagaugca

SEQ ID NO: 1022 - RNA, 63 nt, Homo sapiens
gugugugugugggagagaaggaggcccguguugagcucagggagaccccgguguguccguucu

SEQ ID NO: 1023 - RNA, 62 nt, Homo sapiens
guguuccucaagcugcacuuuggggccaucucugcaguauuagcccccuuuuugcuuggugg

SEQ ID NO: 1024 - RNA, 64 nt, Homo sapiens
guguuugccuuugaacacaucuucuugcugaacauuauguagcagaccugcuuaacuuugacuu

SEQ ID NO: 1025 - RNA, 62 nt, Homo sapiens
guguuuuaaaccucagaaacagauuugaguguuucaguauuauagaaacagugaugacuauu

SEQ ID NO: 1026 - RNA, 64 nt, Homo sapiens
guguuuuuccgacagugguuaauaauuauauuggugauguagcagcaauuguguuggcaggguu

SEQ ID NO: 1027 - RNA, 64 nt, Homo sapiens
guuaaccuucauacaaaauauaaaggcccagaacagauguagcaaggaaauuucaauuuucccc

SEQ ID NO: 1028 - RNA, 62 nt, Homo sapiens
guuaagcucacccuguucuuugaagcacccaugucaguauuagaagaauaggcagcaguucc

SEQ ID NO: 1029 - RNA, 62 nt, Homo sapiens
guuaaugauggacagcauuauuaggaacccuguaguaugauauuuaacaauauaggcuucaa

SEQ ID NO: 1030 - RNA, 62 nt, Homo sapiens
guuacagagugaacacucuacuacaugugacuggcaguauuaagugugcuuauuuuaaaugu

SEQ ID NO: 1031 - RNA, 61 nt, Homo sapiens
guuacuacaauaauacauguauuguguuuuccauggugcuacaguuacacaauauggaggc

SEQ ID NO: 1032 - RNA, 63 nt, Homo sapiens
guuacuuuggcaauuuccuggcccuccacuccucauccccacaaucuggcuuagugccaccca

SEQ ID NO: 1033 - RNA, 62 nt, Homo sapiens
guuagaagacuaaacauacguacccaccaugaauguaugauacaugaaauuuggccuucaau

SEQ ID NO: 1034 - RNA, 62 nt, Homo sapiens
guuagauuuuguguguaacaguguuguaccuggacaguauuagaaauuuguaugcuuauucu

SEQ ID NO: 1035 - RNA, 63 nt, Homo sapiens
guuagugccgugcucuaaccaaguaagcuuaguguuccccacagugaucuguaucuggccuga

SEQ ID NO: 1036 - RNA, 63 nt, Homo sapiens
guuauccuguaacauaaauuuuauuaaauaauacuuccccacagaugagaggcacgcaacacc

SEQ ID NO: 1037 - RNA, 61 nt, Homo sapiens
guuauuagaccaguuuuaaaauugucaauaucacaguauuacaggugcuauuuuuuucagu

SEQ ID NO: 1038 - RNA, 64 nt, Homo sapiens
guucaaaugaagauggcuuuuguacuuccuguggacauguagcaaugucuauauuggcucauaa

SEQ ID NO: 1039 - RNA, 63 nt, Homo sapiens
guucagaccugacaagauucuuugaauacagauaaugaauguaaacaauuaacuguuuauaau

SEQ ID NO: 1040 - RNA, 62 nt, Homo sapiens
guucauauagaacugauaauguagcaagccccaaguaugauaauaggcagacuauucccaac

SEQ ID NO: 1041 - RNA, 63 nt, Homo sapiens
guucauuccaaucuucuaauuacagugguuccuaucucagggauacuggacuuucugacgcag

SEQ ID NO: 1042 - RNA, 63 nt, Homo sapiens
guucauuuggguuugcuuacuugacccuguggagauccccacagccauugggcauccuaggug

SEQ ID NO: 1043 - RNA, 63 nt, Homo sapiens
guuccagaaguucugagggcuggacaucggcccgcuccccacaaugaaauaaaguuauuuucu

SEQ ID NO: 1044 - RNA, 63 nt, Homo sapiens
guuccagguggccauagucagucaccaugugugggcucagggacccccaggaccaggaugugu

SEQ ID NO: 1045 - RNA, 64 nt, Homo sapiens
guuccuuuguaagggugggcaggccucguaagaaagauguagcagcauauucacuauccguuaa

SEQ ID NO: 1046 - RNA, 63 nt, Homo sapiens
guucguaaagaaaauuacuucugguauuuaggcugugaauguaccuugaaggggagaguucau

SEQ ID NO: 1047 - RNA, 62 nt, Homo sapiens
guucuaaucauuucagcaguagcgucuuaaacagcaguauuacuauaagcaguugcuucaaa

SEQ ID NO: 1048 - RNA, 62 nt, Homo sapiens
guucugacucaucacaagaggucaaaaguauuugcuacuguaacauucaauucacauuugag

SEQ ID NO: 1049 - RNA, 61 nt, Homo sapiens
guucugcccaucaccccccgccccugcuggccuuggugcuaaggaaguggggagagcaggc

SEQ ID NO: 1050 - RNA, 62 nt, Homo sapiens
guucuucuaaagccuacguugguuaggcugauggcaguauuauaguugcuaaauucagcacu

SEQ ID NO: 1051 - RNA, 62 nt, Homo sapiens
guugaaacuguuaaaauuccaauuuguuuucauucaguauuaguuuaguucuaaauauagca

SEQ ID NO: 1052 - RNA, 63 nt, Homo sapiens
guugaacacacuaugaagaauuccagguguacuagugaauguaauuuauaguugccaaaaaaa

SEQ ID NO: 1053 - RNA, 62 nt, Homo sapiens
guugaccauccuuucuuuuuauaguauauuucuuguaugauauuuuguaaagcucucaccug

SEQ ID NO: 1054 - RNA, 63 nt, Homo sapiens
guugacugugagcaaagugucuuccgauuagcagccucagggaugcccugguggccucuccag

SEQ ID NO: 1055 - RNA, 63 nt, Homo sapiens
guugagcgagccccggcgcaugccgggcaccggguuccccacacugggcagugacggggccca

SEQ ID NO: 1056 - RNA, 63 nt, Homo sapiens
guugaggguacaggcaaccuuguguucucugugcccucagggacuggcagagcaagaggccau

SEQ ID NO: 1057 - RNA, 62 nt, Homo sapiens
guugauacucccccaccucccccauuuagauacacuacuguauuagugagaauacuugguac

SEQ ID NO: 1058 - RNA, 63 nt, Homo sapiens
guugauguuuuaacucuaucugucauacauccuagugaauguaaaaugcaaaauccuggugau

SEQ ID NO: 1059 - RNA, 62 nt, Homo sapiens
guugauuuuauauauguuacaaaagguuggauuuguaugauagcuguaaucccaagucaagu

SEQ ID NO: 1060 - RNA, 63 nt, Homo sapiens
guugcaagggcaaccucguccauuuuaacuggcaccucagggauuaaaauccuacuuuuuagu

SEQ ID NO: 1061 - RNA, 63 nt, Homo sapiens
guugccuuaguacuaucaagacuugugaauauauuugaauguauguuguuugaaaaacuugca

SEQ ID NO: 1062 - RNA, 63 nt, Homo sapiens
guugcuguccucuuggcaucugaguccuuucccuguccccacaagcccuucuacucccuguuu

SEQ ID NO: 1063 - RNA, 62 nt, Homo sapiens
guugggaauuuuuaucucccuuugucuccuuaaccuacuguaaacuggcuuuugcccuuaac

SEQ ID NO: 1064 - RNA, 62 nt, Homo sapiens
guugggauuuuuuuuuuuuuuuuguaacuggcuuguaugauauuuucuuucuguauuucucu

SEQ ID NO: 1065 - RNA, 62 nt, Homo sapiens
guuguuuucuccccugauuaauggugauauucaaguaugauacaaaaagaauuguaccaccc

SEQ ID NO: 1066 - RNA, 62 nt, Homo sapiens
guuuaaaaauuguaaaauucaaguuaaaugacguguaugauauauaagcugaacacauuuuc

SEQ ID NO: 1067 - RNA, 62 nt, Homo sapiens
guuuaaaaucaagaguguauuguuuacuguuuuacaguauuauuuaauauccaacuggucuc

SEQ ID NO: 1068 - RNA, 62 nt, Homo sapiens
guuuaacauaauaauguuuuaaagacuuaguugucaguauuaaauaauccuggcauuauagg

SEQ ID NO: 1069 - RNA, 63 nt, Homo sapiens
guuuagggagaagcagccagacuugcuuugugaacugaauguauuuuuaugcaauuuugagug

SEQ ID NO: 1070 - RNA, 62 nt, Homo sapiens
guuuaguauauagagacaauuuuaauggaaauaacuacuguagacuauugaagaaugaucuc

SEQ ID NO: 1071 - RNA, 62 nt, Homo sapiens
guuuaugcugugauuucacucugucuaucaugggcaguauuagaaaacacacugguuuucac

SEQ ID NO: 1072 - RNA, 61 nt, Homo sapiens
guuucagucccuaaaaaaugaaauggaaaaaaguggugcuaaaucgagucagagauauuac

SEQ ID NO: 1073 - RNA, 63 nt, Homo sapiens
guuuccugagauuagaaccuguguguaugcacaugugaauguaugugugagugcacaugugug

SEQ ID NO: 1074 - RNA, 56 nt, Homo sapiens
guuucuagggagaaagugaccguauacaugaauguauuuaucuaucaaauuacuga

SEQ ID NO: 1075 - RNA, 62 nt, Homo sapiens
guuucucgacuuguauuuauuaaauacucaaacucaguauuaccuacucaaugccuuuuaaa

SEQ ID NO: 1076 - RNA, 63 nt, Homo sapiens
guuucuuauugcuuuuccuucccuaauucauacaaugaauguauuuggaauacuuacauauua

SEQ ID NO: 1077 - RNA, 63 nt, Homo sapiens
guuuggccucagaacuccauguuuguuucucucuauccccacagaagucuacagggcaacuuc

SEQ ID NO: 1078 - RNA, 62 nt, Homo sapiens
guuuuacuguaaugguaaggauugacucaagagacaguauuaguaaauuuauuguguaugga

SEQ ID NO: 1079 - RNA, 64 nt, Homo sapiens
guuuuagaaauauuaauuuacuugaagagauguagaauguagcaaauuauguaaagcaugugua

SEQ ID NO: 1080 - RNA, 64 nt, Homo sapiens
guuuuaguacaucauagcacuuuauuuuaugaaaacauguagcagauuuuccacaaaaaugcuu

SEQ ID NO: 1081 - RNA, 64 nt, Homo sapiens
guuuuccaacauuuguuaauaguuacgucucuccugauguagcacuuaagcuucauuuaguuau

SEQ ID NO: 1082 - RNA, 62 nt, Homo sapiens
guuuucuccuguguuauauaugcauuaugugcagguaugauauuuucuucacuacuuuuucu

SEQ ID NO: 1083 - RNA, 63 nt, Homo sapiens
guuuugacacugagcuuggggcuuuuuccaucuucuccccacagccucuggcuccacaccucc

SEQ ID NO: 1084 - RNA, 64 nt, Homo sapiens
guuuugcacacuuugccauauuuucaccauuugauuauguagcaaaauacaugacauuuauuuu

SEQ ID NO: 1085 - RNA, 62 nt, Homo sapiens
guuuuucuguguuguuuucccuggaugaaaauaucaguauuaaguagacagcauauuauuca

SEQ ID NO: 1086 - RNA, 62 nt, Homo sapiens
guuuuuguuuuuuaaguagccacuuuuaauuacucaguauuaauccuaggugcauguguuaa

SEQ ID NO: 1087 - RNA, 62 nt, Homo sapiens
uaaaaauuuuaucgcuguuaagguauuaaucauucaguauuacuaauggaauagaaauucau

SEQ ID NO: 1088 - RNA, 62 nt, Homo sapiens
uaaaaccauaaacauuugccaaaaauucaugccccaguauuagcaaugaauuaguugcauug

SEQ ID NO: 1089 - RNA, 63 nt, Homo sapiens
uaaaaccuuucaaauuucacauccaccucugacuuugaauguaaacugugugaauaaaguaaa

SEQ ID NO: 1090 - RNA, 62 nt, Homo sapiens
uaaaagagaaauuauauaauuuauuuaguaaauacuacuguaaacuauaguuuugugagaga

SEQ ID NO: 1091 - RNA, 63 nt, Homo sapiens
uaaaagcaaguuauaucagugaaguaagauccuuuugaauguacaaagacccacacuauugag

SEQ ID NO: 1092 - RNA, 62 nt, Homo sapiens
uaaaaguuuauaagauuuuuaugaagcagccacuguaugauauuuuaagcaaauauguuauu

SEQ ID NO: 1093 - RNA, 62 nt, Homo sapiens
uaaaauagugguuaucuuugugugcggugaauauguaugauacuuguuuucuuuuucaugcu

SEQ ID NO: 1094 - RNA, 62 nt, Homo sapiens
uaaacaaaucccuaacacgugguaugggugaaccguaugauaugcuuugccauugugaaacu

SEQ ID NO: 1095 - RNA, 63 nt, Homo sapiens
uaaacaugcccgggcuucgaugugccuggaggauuuccccacagggacccacgcaccucccug

SEQ ID NO: 1096 - RNA, 61 nt, Homo sapiens
uaaacccauuuuggugcaauauucuugacuccuuggugcuaaagauuguuaaauucaaugc

SEQ ID NO: 1097 - RNA, 62 nt, Homo sapiens
uaaacugaaaaaugucagucugguuuauauaaggcaguauuauugagcucuauuuccccacc

SEQ ID NO: 1098 - RNA, 62 nt, Homo sapiens
uaaacugcaagauagauaggaugaaacuuuuggccuacuguauuacuuacagaguuuuuuug

SEQ ID NO: 1099 - RNA, 62 nt, Homo sapiens
uaaacuucuguaaccuaugcauauuuuaugggggcaguauuauuacaaauggaucugaaaug

SEQ ID NO: 1100 - RNA, 62 nt, Homo sapiens
uaaacuuggccuaaaaucaaaccuuggcacagagguaugauacaacuuuaacaggagucauc

SEQ ID NO: 1101 - RNA, 63 nt, Homo sapiens
uaaaggucucaucccacaaccccugacuuccucccuccccacaucaugaaggcagaggcaugc

SEQ ID NO: 1102 - RNA, 62 nt, Homo sapiens
uaaagguguuaauuaauggguauaaaauuuaaaucaguauuacuggcagacguuauuuuagg

SEQ ID NO: 1103 - RNA, 63 nt, Homo sapiens
uaaaucaauggcaaauaagucaagaugacauuuugugaauguagacuauggauacacuccuaa

SEQ ID NO: 1104 - RNA, 62 nt, Homo sapiens
uaaaucuuaaauuaugugaacuauuaaauagacccuacuguacugugcuuuggacauuugaa

SEQ ID NO: 1105 - RNA, 62 nt, Homo sapiens
uaaaugucucuugcaaaacaaaguaagauaccaccaguauuacaacacaaugauuuuccaga

SEQ ID NO: 1106 - RNA, 62 nt, Homo sapiens
uaaauuccaauuucuauuuacuuauucauugugacaguauuacuaaacagguaaggauggga

SEQ ID NO: 1107 - RNA, 61 nt, Homo sapiens
uaacacuccuaagaaauguugauggcuauuuuguggugcuaacauguaguuggggcaccua

SEQ ID NO: 1108 - RNA, 61 nt, Homo sapiens
uaacagauugaauuuuaagagugcgaaacacucuggugcuauagggaaggaacuucauaaa

SEQ ID NO: 1109 - RNA, 62 nt, Homo sapiens
uaacauacuguauacucuauagcaguauuacagucaguauuucauauaauuuucuuuagacc

SEQ ID NO: 1110 - RNA, 63 nt, Homo sapiens
uaacauagguuuuuagucuaauugaaucccuuaaacucagggagcauuuauaaauggacaaau

SEQ ID NO: 1111 - RNA, 63 nt, Homo sapiens
uaacauuucuuggcaacagaaagccccaggcacagcucagggaggagggaaggcagguaagcu

SEQ ID NO: 1112 - RNA, 63 nt, Homo sapiens
uaaccacauucaugcuuacccugcugcucagcuuucucagggaagcaacuccaggaacacucc

SEQ ID NO: 1113 - RNA, 61 nt, Homo sapiens
uaaccagccuuguaacaauauguuuucuccuuuuggugcuaaaaaaugaaaauauuagaaa

SEQ ID NO: 1114 - RNA, 63 nt, Homo sapiens
uaaccaggccgagaggccacacacuugcccccccauccccacaaaccagguaaugccaguuug

SEQ ID NO: 1115 - RNA, 62 nt, Homo sapiens
uaaccgaaaaaugacccaagacuuaguucuugcccuacuguaucugccuuguuugguugguu

SEQ ID NO: 1116 - RNA, 62 nt, Homo sapiens
uaacugcucaguagguuacaaaugaagaguccaccaguauuagaaacaauuuaaacuugcca

SEQ ID NO: 1117 - RNA, 63 nt, Homo sapiens
uaacuugucuuuuuguuaugcaaaugagauuucuuugaauguauuguucuguuuguguuauuu

SEQ ID NO: 1118 - RNA, 62 nt, Homo sapiens
uaacuuguucugaaguugucuauuggauuucuuucuacuguacccugauuauuacuuccauc

SEQ ID NO: 1119 - RNA, 63 nt, Homo sapiens
uaagaaaaaaauuugccuuuaagaguuacuuuuguugaauguauuugacuuaguucuuauuuu

SEQ ID NO: 1120 - RNA, 62 nt, Homo sapiens
uaagauacuuauaugagaacuacaaucaccgaaucuacuguauucaauauuagcagaucuaa

SEQ ID NO: 1121 - RNA, 64 nt, Homo sapiens
uaagaugccaucugaaggggauucugaucuguucuuauguagcacuuaacacuguguagaaacu

SEQ ID NO: 1122 - RNA, 63 nt, Homo sapiens
uaagccuuuuuuuucuuuuuuuuuuuuuuggcaaaugaauguaccauuucaacuuugauuuua

SEQ ID NO: 1123 - RNA, 62 nt, Homo sapiens
uaagcugcuaauuguaaacaaaacaguuacccuccaguauuaauaugacucauuagugugag

SEQ ID NO: 1124 - RNA, 63 nt, Homo sapiens
uaagggauaaaggccuuuuacagaagcuaaacccuuccccacaugugguagaaugugcucuuc

SEQ ID NO: 1125 - RNA, 63 nt, Homo sapiens
uaaggguagggguauaagucuguuccaugcagucacucagggacccagucuccuuuugucugg

SEQ ID NO: 1126 - RNA, 63 nt, Homo sapiens
uaaggguuucaaucaauuauuaaugcagagaguauugaauguaaaucagagcucucuagucuu

SEQ ID NO: 1127 - RNA, 63 nt, Homo sapiens
uaaguaaaguuuugcacagcuuacaugauacuguaugaauguaugaaaaaaaaggagaaaaaa

SEQ ID NO: 1128 - RNA, 63 nt, Homo sapiens
uaagugcccacauuugauggaggguggaaauaauuugaauguauuugauuuauaaguuuuuuu

SEQ ID NO: 1129 - RNA, 63 nt, Homo sapiens
uaagugggcccuugugcugugaggaagaccaaagccucagggaagauaagagauauggagaug

SEQ ID NO: 1130 - RNA, 62 nt, Homo sapiens
uaaguuucacaucuaugguagauuuuugaggugucuacuguaaaguauugcuuacaaaaagu

SEQ ID NO: 1131 - RNA, 62 nt, Homo sapiens
uaauaauuggcuauauuugguaccugucucucuccuacuguauugucauuuucaaaaugugu

SEQ ID NO: 1132 - RNA, 63 nt, Homo sapiens
uaauacucuuguaggagaaaaagcaacuguauaaaugaauguagagugacuuucugcaauauu

SEQ ID NO: 1133 - RNA, 61 nt, Homo sapiens
uaauauuugggaaggcuuuaaagacgcauguuauggugcuaauguacuuucacuuuuaaac

SEQ ID NO: 1134 - RNA, 62 nt, Homo sapiens
uaaucagauuaagauugaccauugcuccuuuacacaguauuagucuagcauucaauuauuuc

SEQ ID NO: 1135 - RNA, 61 nt, Homo sapiens
uaaucaggccccuguuaugcuuagggggagcccuggugcuacuugcuugaaguuuucagug

SEQ ID NO: 1136 - RNA, 63 nt, Homo sapiens
uaauccaaagugcacuauuugaucuaguauggauuugaauguacaauuuaucgauggcuuagu

SEQ ID NO: 1137 - RNA, 62 nt, Homo sapiens
uaaucccauugcaaacauuauuccaagaguaucccaguauuagcaauacuggaauauaggca

SEQ ID NO: 1138 - RNA, 62 nt, Homo sapiens
uaaucuggcacaacacuaauuaccauuuuuaaagcaguauuaaguuguaauuuaaaccuugu

SEQ ID NO: 1139 - RNA, 63 nt, Homo sapiens
uaaugauauacucagauauaaacaccuuguuuucuugaauguaauuuauuuauuagcuaaaaa

SEQ ID NO: 1140 - RNA, 63 nt, Homo sapiens
uaaugcccuuuagggcacaacuaguuaucaguaacugaauguaucuuaaucauuauggcugcu

SEQ ID NO: 1141 - RNA, 62 nt, Homo sapiens
uaauguuuugggaaacacugaaaugaaaucuucccaguauuauaaauuguguauuuaaaaaa

SEQ ID NO: 1142 - RNA, 64 nt, Homo sapiens
uaauuaagugaaaaaaguuuaaucccagaagaguaaauguagcaugaugcccuuucuaaaugaa

SEQ ID NO: 1143 - RNA, 62 nt, Homo sapiens
uaauucagauguuuuacgcaaggaaggacuuacccaguauuacugcugcugugcuuuugauc

SEQ ID NO: 1144 - RNA, 61 nt, Homo sapiens
uaauugaagccugacucagcuaaugucacaacauggugcuacuucuucuucuuuuuguuaa

SEQ ID NO: 1145 - RNA, 63 nt, Homo sapiens
uaauugaauuucucugcaguaguccuucaagcacuugaauguaaaccuuuagcauuuauucgu

SEQ ID NO: 1146 - RNA, 62 nt, Homo sapiens
uaauuucauuaagaggaacaucaggcauugcaaucaguauuaaucaggggcucaaauacaga

SEQ ID NO: 1147 - RNA, 62 nt, Homo sapiens
uaauuuugacuaaagaaauacuuuugaaguaugacaguauuaagucauaagauuuaaucuca

SEQ ID NO: 1148 - RNA, 64 nt, Homo sapiens
uaauuuuguaaaggugaaaaaagcuuuuaugagcucauguagcaaucagauuuuccuguggcuc

SEQ ID NO: 1149 - RNA, 63 nt, Homo sapiens
uaauuuuuauuuuuuuaaaggaacccuucuccuuguccccacaaccccagcaacaaaagaaag

SEQ ID NO: 1150 - RNA, 61 nt, Homo sapiens
uaauuuuuuaaucuuaguuuaauggucucucccuggugcuaacugcugacaguggccaccu

SEQ ID NO: 1151 - RNA, 63 nt, Homo sapiens
uacaaaauucucauuuaauuuucuggucagcaaguuccccacacagaaaucacucugagguuu

SEQ ID NO: 1152 - RNA, 64 nt, Homo sapiens
uacaaaugaaaaaaaucucauaaaaauacauaaacuauguagcaaaaguaucuguaaaauccau

SEQ ID NO: 1153 - RNA, 62 nt, Homo sapiens
uacaaaugugcagcgaaauaccccaaagcuuuuccuacuguacagaucucucgagucugcuu

SEQ ID NO: 1154 - RNA, 63 nt, Homo sapiens
uacaaccugggguuccuucucagggccucaccugguccccacauccccuggccucugcuccug

SEQ ID NO: 1155 - RNA, 62 nt, Homo sapiens
uacaauauuuauaacuauaaacuuuauagaaguacaguauuaaagucagugguacacagaca

SEQ ID NO: 1156 - RNA, 62 nt, Homo sapiens
uacaauuuaucuaaacugaauugagaaaaaauuacaguauuauuccucaaaauaacaucaau

SEQ ID NO: 1157 - RNA, 63 nt, Homo sapiens
uacacauaagccaaaacugagcauaaguccucuagugaauguaggcuggcuuucagaguaggc

SEQ ID NO: 1158 - RNA, 63 nt, Homo sapiens
uacacauagcccagaacuuguagaauucugcauagugaauguauauugaauuagucuccugcc

SEQ ID NO: 1159 - RNA, 62 nt, Homo sapiens
uacacauuuauuuuuucauuuagauacuuuccuucaguauuaugauugagacauuaaccuca

SEQ ID NO: 1160 - RNA, 63 nt, Homo sapiens
uacaccaugcccuugaacucaaagcaaacuacgcucucagggaaauacaaauaucacguucuu

SEQ ID NO: 1161 - RNA, 63 nt, Homo sapiens
uacagaaggaagggagucccaucucaaaaaaaaaaugaauguaugccacugcaauuagaguau

SEQ ID NO: 1162 - RNA, 63 nt, Homo sapiens
uacagagcuauguaaagggacuuaggagaaaaugcugaauguaagauggucccauuucaauuu

SEQ ID NO: 1163 - RNA, 63 nt, Homo sapiens
uacagcaaacaaccaugugguuggauuacauggaguccccacauacucagucaguuaucaaag

SEQ ID NO: 1164 - RNA, 63 nt, Homo sapiens
uacaguaggccuuuuguuuauuaauggaagaguacuccccacaccuaagaccagauucuuaua

SEQ ID NO: 1165 - RNA, 63 nt, Homo sapiens
uacauaaauucuacuuuauuccucaacuucuuugaugaauguaacccaauuuuacuucuuuaa

SEQ ID NO: 1166 - RNA, 62 nt, Homo sapiens
uacauaaguauaagcagguccgcccagggcuuggcuacuguagguguccaauaaacaguaga

SEQ ID NO: 1167 - RNA, 63 nt, Homo sapiens
uacauaugguagacaauuugccuuaggaagugacuugaauguacaaagauacuugaugcacuu

SEQ ID NO: 1168 - RNA, 49 nt, Homo sapiens
uacaucaccgccuugguaaaacaguauuauaaaaucaaaauauggguaa

SEQ ID NO: 1169 - RNA, 62 nt, Homo sapiens
uacauccuggguaaugagagguggcuuuugcggccaguauuagacuggaaguucauaccuaa

SEQ ID NO: 1170 - RNA, 63 nt, Homo sapiens
uacauguugguuucaucuucgcugucucucucauuuccccacaaaguguugucucacuuucug

SEQ ID NO: 1171 - RNA, 62 nt, Homo sapiens
uaccaccaauaguguaugugagccuuauuuuuauguaugauaggacuuuuuuuaguccaaau

SEQ ID NO: 1172 - RNA, 63 nt, Homo sapiens
uaccagauucacuucugaauuggccagaggaaaucugaauguauuauccugugugugucuagg

SEQ ID NO: 1173 - RNA, 63 nt, Homo sapiens
uaccagcaggagguucugggccucugaacccccuuuccccacaccucccccugcugcugcugc

SEQ ID NO: 1174 - RNA, 63 nt, Homo sapiens
uaccaucgccuuccaaagucagcacucuacacucuugaauguaccaaggaucucuuggcgaca

SEQ ID NO: 1175 - RNA, 64 nt, Homo sapiens
uaccauuucugaucaugaaauauuggcuacugguguauguagcaguucuuaaaucagcaguauu

SEQ ID NO: 1176 - RNA, 63 nt, Homo sapiens
uacccaaaguucagucuagauggcacaaaccaccucucagggaauaaacccuaagacaucacu

SEQ ID NO: 1177 - RNA, 63 nt, Homo sapiens
uaccccacggccuugucuuggaacugcuccugcuauccccacacccugcuuccucaccccacu

SEQ ID NO: 1178 - RNA, 63 nt, Homo sapiens
uacccuccucugggagccugcuucgaauagugggacucagggagauaagaccuucuugcugga

SEQ ID NO: 1179 - RNA, 62 nt, Homo sapiens
uaccgcaaggccuccuggauccaaagcaccaugucaguauuauuuguugguccuuuuugugc

SEQ ID NO: 1180 - RNA, 64 nt, Homo sapiens
uaccuagcaguacuuuauauaguauagcuuugggccauguagcauuuuaagacucaauuuuaaa

SEQ ID NO: 1181 - RNA, 62 nt, Homo sapiens
uaccuauauauucuauuuaauacuugguuuauuucuacuguacauuguuuucuuugucccaa

SEQ ID NO: 1182 - RNA, 62 nt, Homo sapiens
uaccuguaucaaaggaauuuuaacaaagagcaaucaguauuauuggaccaaauuugguguuu

SEQ ID NO: 1183 - RNA, 63 nt, Homo sapiens
uaccuuauuuucucuuggaacauaucugaaaaccuuccccacaaauaacuugucacaccuuuu

SEQ ID NO: 1184 - RNA, 63 nt, Homo sapiens
uaccuucuaaaagauaagugcuaugacaccauguaugaauguaauucucuuaguaauuuaccu

SEQ ID NO: 1185 - RNA, 62 nt, Homo sapiens
uaccuuuucagaaaccugcuuucauuugcuuagccaguauuagaacagaucuuuacaacagc

SEQ ID NO: 1186 - RNA, 62 nt, Homo sapiens
uacgaauuguuucacaaacagaaaacauguaaagcaguauuaaaauuuggccaaacaagugu

SEQ ID NO: 1187 - RNA, 62 nt, Homo sapiens
uacuaaugaaguuuuaaauuaacaaccacuacuuguaugauaugaauaauauuuagaaaugu

SEQ ID NO: 1188 - RNA, 64 nt, Homo sapiens
uacuagauuaccaaguguuacaucauauuaaauaaaauguagcagaaccaucugcaucaauaua

SEQ ID NO: 1189 - RNA, 62 nt, Homo sapiens
uacuaugauguaacuccccuuccuuauggcuaggcuacuguaacacuugccuguaaucagug

SEQ ID NO: 1190 - RNA, 62 nt, Homo sapiens
uacucaugucgcuucuccuuguguuacccccucccaguauuaccauuugccccucaccugcc

SEQ ID NO: 1191 - RNA, 64 nt, Homo sapiens
uacucauuuuaucauuauaaaugugcuuaguucaucauguagcaucgccccaguuacacaucag

SEQ ID NO: 1192 - RNA, 64 nt, Homo sapiens
uacucuauaugaccagagauguucuugggaauuacaauguagcaagagauaauuucuaaaauaa

SEQ ID NO: 1193 - RNA, 61 nt, Homo sapiens
uacugaauaaggugcuucugcuucuucuagagauggugcuaaagaaaggacuagcauauga

SEQ ID NO: 1194 - RNA, 62 nt, Homo sapiens
uacuguuuccaaaauuauuucuauaugacacaaaguaugauaccuuuaaaaaggugagcuua

SEQ ID NO: 1195 - RNA, 61 nt, Homo sapiens
uacuuggcagccaagaauuuggagguuuuaaaauggugcuaauucuguccucugaggucuu

SEQ ID NO: 1196 - RNA, 63 nt, Homo sapiens
uacuuguuuaucuuguugcugcaaugagaaauaaaugaauguauguauuuuggugcuuugaug

SEQ ID NO: 1197 - RNA, 62 nt, Homo sapiens
uacuuuuuuuuacuuuuauaaugcauuuuacucccaguauuauguucauuuaauaaauuauu

SEQ ID NO: 1198 - RNA, 63 nt, Homo sapiens
uagaaaaaugucucuggcucauaaaaugagacucccucagggacuaaauaugaacugacagca

SEQ ID NO: 1199 - RNA, 63 nt, Homo sapiens
uagaaaaauucagacagcaucuucucuauuggccucucagggaacaucaguauagaucuuucc

SEQ ID NO: 1200 - RNA, 63 nt, Homo sapiens
uagaaaguggggucaggaggccaagaaagggaauaugaauguauauccaagucacucaggaac

SEQ ID NO: 1201 - RNA, 64 nt, Homo sapiens
uagaacacacacaaacuuaaaauggaaaguuaccaaauguagcacuagaggcaagaaaaggggu

SEQ ID NO: 1202 - RNA, 61 nt, Homo sapiens
uagaagacuaaacacuggcccaaacuuaaccauuggugcuagggggacaggggugggguga

SEQ ID NO: 1203 - RNA, 62 nt, Homo sapiens
uagaagcauaccauuuuccuuucauggaaggguacaguauuacaaagauaauuuguuuaacu

SEQ ID NO: 1204 - RNA, 63 nt, Homo sapiens
uagaaggagucccaucaggagggaagauggugggccucagggaggauggggaucaagggacag

SEQ ID NO: 1205 - RNA, 63 nt, Homo sapiens
uagaaguugucugugggugauguuacuguaguggucucagggaaaggauuguccaguuacuuu

SEQ ID NO: 1206 - RNA, 63 nt, Homo sapiens
uagaauagauuaauaaauuggcuauguuguuccaaugaauguacagcacuuccauuaacuuuu

SEQ ID NO: 1207 - RNA, 62 nt, Homo sapiens
uagaauguuaauguccuaguauuauuccgaacuacaguauuaacugcuuguugcuaguggau

SEQ ID NO: 1208 - RNA, 64 nt, Homo sapiens
uagagauagcaagggauaauuaaauaaauauucccuauguagcaacagugguuagaugaucuuu

SEQ ID NO: 1209 - RNA, 63 nt, Homo sapiens
uagaguacuuuuuaaaauuauuucucacaaagaaaugaauguacaauccaaugaaaacauuug

SEQ ID NO: 1210 - RNA, 63 nt, Homo sapiens
uagauccauuuugugccacacuccauuguagacuuugaauguaguagucuuuccaagagccua

SEQ ID NO: 1211 - RNA, 63 nt, Homo sapiens
uagcaaaugggcccugacuguaaauuagugaagagugaauguaacuuauuacccacagggaca

SEQ ID NO: 1212 - RNA, 62 nt, Homo sapiens
uagcacuuuuuuuaaguuagugauuacaguuuaccuacuguauagaauaauuuucuaauaau

SEQ ID NO: 1213 - RNA, 62 nt, Homo sapiens
uagccaaaccauaucacuggugaugccacuucuucaguauuagggauucucagucagaagag

SEQ ID NO: 1214 - RNA, 62 nt, Homo sapiens
uagccauaagaaaauaucugcuauacaggaaaaccaguauuaagcaaauaccaccauccuua

SEQ ID NO: 1215 - RNA, 62 nt, Homo sapiens
uagcccagugcggcuccacagcauggaaucugauguaugauaugauagaauguggcacuaaa

SEQ ID NO: 1216 - RNA, 62 nt, Homo sapiens
uagccuaggaaauuuaacauauauauaacuauagcaguauuaauaaugauaguuguacuucu

SEQ ID NO: 1217 - RNA, 62 nt, Homo sapiens
uagccuuugagugucugucauggugcauccguuucaguauuauuuccuaaaaugagaagccc

SEQ ID NO: 1218 - RNA, 61 nt, Homo sapiens
uagcuuaaaaauguuggggguuggggggaagaguggugcuagccaggaagaagccaguaaa

SEQ ID NO: 1219 - RNA, 63 nt, Homo sapiens
uaggaauaaauguaagauuuuacaaaucuuuuauuuccccacaagaucugaaguuugguauuu

SEQ ID NO: 1220 - RNA, 62 nt, Homo sapiens
uaggagucaaguuacuggugccacagaucuggagguaugauaggucaggggcuagguguuga

SEQ ID NO: 1221 - RNA, 62 nt, Homo sapiens
uagggaaaaaacugcguaaaaacuauugcauuauguaugauaagaaaguaaguauuccaaag

SEQ ID NO: 1222 - RNA, 61 nt, Homo sapiens
uaggggcaccgugagugcagcgcggggucuccauggugcuaggccaggguggccagccccg

SEQ ID NO: 1223 - RNA, 62 nt, Homo sapiens
uaggguggguauagaugcauagauaugggauuauguaugauauauauauauauacacacaca

SEQ ID NO: 1224 - RNA, 63 nt, Homo sapiens
uagguauauaaaauucauagugauaaauuuucucaugaauguaucuguguauaacauuuuaua

SEQ ID NO: 1225 - RNA, 62 nt, Homo sapiens
uaggucagacuuuuccuuucaucuuuguguucaucuacuguaaaguguccgucugugucugu

SEQ ID NO: 1226 - RNA, 62 nt, Homo sapiens
uaguaggaagaaaaaccuuuauuuggaauauacacuacuguaaguuuguacagaucauauac

SEQ ID NO: 1227 - RNA, 63 nt, Homo sapiens
uaguaugggaauuauuuuuuauguuaaauagaaacugaauguacuggguugaaugguguccuc

SEQ ID NO: 1228 - RNA, 62 nt, Homo sapiens
uagugccucuggauuuagagauauauauccuaggguaugauacuacugugacgggucuaaca

SEQ ID NO: 1229 - RNA, 62 nt, Homo sapiens
uagugugaauuaauccuuuugugcuguguuuaaucaguauuagcuuuauagaauuauauaug

SEQ ID NO: 1230 - RNA, 63 nt, Homo sapiens
uaguucaaccauuguggaagucaguguggcgauuccucagggaucuggaacuagaaauaccau

SEQ ID NO: 1231 - RNA, 64 nt, Homo sapiens
uaguucuguuucagaacuuccguaccuuuuucuuguauguagcacguauaaaugcagcugucau

SEQ ID NO: 1232 - RNA, 62 nt, Homo sapiens
uaguuuuaauuuagcucgguucucuuguuggugccaguauuacauugaagacuaccuaugau

SEQ ID NO: 1233 - RNA, 63 nt, Homo sapiens
uaguuuuuuuuuaaaugcuuguucuaagacauuucugaauguagaccauuuuccaaaaaggaa

SEQ ID NO: 1234 - RNA, 62 nt, Homo sapiens
uauaaaacugccacaauuguauuuuaauuuugagguaugauauuuucagauauuucauaauu

SEQ ID NO: 1235 - RNA, 62 nt, Homo sapiens
uauaaaauauaaggauuacuuuuguauguuccaacaguauuauacuuguuuuggcaucagca

SEQ ID NO: 1236 - RNA, 63 nt, Homo sapiens
uauaaaauguuauuccauucagaggaugccuuuuauccccacauuaaagcacagaucauuaag

SEQ ID NO: 1237 - RNA, 63 nt, Homo sapiens
uauaaagcuuuauucuuuagcccuuaacccuaaggcucagggaaauacccuauguuauugugc

SEQ ID NO: 1238 - RNA, 62 nt, Homo sapiens
uauaaaguauacagaaacauuaucugaaagcaaaguaugauaguuuguuuugcuauacagua

SEQ ID NO: 1239 - RNA, 62 nt, Homo sapiens
uauaaauauuuggucucuauuucauuuuuugcaucaguauuaauacuaaaauaugucucgcu

SEQ ID NO: 1240 - RNA, 63 nt, Homo sapiens
uauaaauuauaaaugcaauuaacuaagaacagcucugaauguauuugcaugggauugguccuu

SEQ ID NO: 1241 - RNA, 63 nt, Homo sapiens
uauaaauuaucugaauauuagaugcucugagaaauugaauguaccuuauuuaaaagauuuuau

SEQ ID NO: 1242 - RNA, 62 nt, Homo sapiens
uauaaauuaugcagaguuauuuuccuauaucucacaguauuaaaaauaaauaauuaaaaauu

SEQ ID NO: 1243 - RNA, 61 nt, Homo sapiens
uauaacuuuugcauaugugagaaaagacaacauuggugcuaacagugaaguaaggcccaaa

SEQ ID NO: 1244 - RNA, 62 nt, Homo sapiens
uauaagcaauaauauccacuaguguuguuaucagcuacuguaaccaaguggcugguucauuu

SEQ ID NO: 1245 - RNA, 62 nt, Homo sapiens
uauaagcuauuucauaaaagcagcuuuaaauugucaguauuaagguuuucauguggaaaggu

SEQ ID NO: 1246 - RNA, 63 nt, Homo sapiens
uauaauuuguuaacacuagaaaccuauuaguauugugaauguagauuuuacugugaagcuauc

SEQ ID NO: 1247 - RNA, 63 nt, Homo sapiens
uauagcauuuuucaacauuuaauggucuguacaguugaauguaaguguucaauauguauugcu

SEQ ID NO: 1248 - RNA, 62 nt, Homo sapiens
uauagucaucuguuaugcugugaaauuuggaauucaguauuaucauuuugaagucuguaaau

SEQ ID NO: 1249 - RNA, 64 nt, Homo sapiens
uauauaaguacugaaucaguauuuauuaaguaaaugauguagcacuguagugauuaggaaucau

SEQ ID NO: 1250 - RNA, 63 nt, Homo sapiens
uauauauaaaaaucuugagaugguagaaacauguaugaauguacuaaguaguauuccacugua

SEQ ID NO: 1251 - RNA, 63 nt, Homo sapiens
uauauaugacguuguacauugcacauacccuuggauccccacaguuugguccuccucccagcu

SEQ ID NO: 1252 - RNA, 62 nt, Homo sapiens
uauaucaguuuuuuuccccuucggucuuccacagcaguauuauugucuuuguggaguugacu

SEQ ID NO: 1253 - RNA, 61 nt, Homo sapiens
uauauggcaacugcagaaggcugagccuccucauggugcuauaaccccuugggacacucau

SEQ ID NO: 1254 - RNA, 61 nt, Homo sapiens
uaucaaggaguucuaucaaggcauccaugucaguggugcuaugcugguuacaacuugagau

SEQ ID NO: 1255 - RNA, 63 nt, Homo sapiens
uaucaguaacaauuuaaaggaaacaaccacucuuuugaauguacaacuuuuuuuucugaaaua

SEQ ID NO: 1256 - RNA, 63 nt, Homo sapiens
uaucaugaaaggacuuacacuggagugaaacccuaugaauguaagcaaugugggaaagccuuc

SEQ ID NO: 1257 - RNA, 63 nt, Homo sapiens
uaucauggugauuaugaugguuaaagccuuuacacugaauguaauguuuaauaaagaaauuac

SEQ ID NO: 1258 - RNA, 63 nt, Homo sapiens
uaucauucugucuacaugaacaaucaagaccaggacucagggaacuuuacucuguaacagaaa

SEQ ID NO: 1259 - RNA, 63 nt, Homo sapiens
uauccuggcgaacaccccuacccuucuauugcggguccccacaugcacacagaacucugacac

SEQ ID NO: 1260 - RNA, 62 nt, Homo sapiens
uauccuggugcgaugaugggccuggcaacauuuucuacuguacuuuuguuuaaauuuaauga

SEQ ID NO: 1261 - RNA, 62 nt, Homo sapiens
uaucggcauuacauguguuuauuuacauguccuaguaugauaauguugauucaaucugaaca

SEQ ID NO: 1262 - RNA, 64 nt, Homo sapiens
uaucguuagcuguaaaaguaauauuaugacauauuuauguagcacuucuauuuucagaauaguu

SEQ ID NO: 1263 - RNA, 61 nt, Homo sapiens
uaucuuauguauuucuuuuaaguauuaccauuauggugcuacugagcguuuucuuuuggua

SEQ ID NO: 1264 - RNA, 63 nt, Homo sapiens
uaucuucagcaaauuccuaugagagaauaauguaaugaauguaggaaaaucuuuagccuuauc

SEQ ID NO: 1265 - RNA, 62 nt, Homo sapiens
uaugaaacauuuuuaagacaaaggcauuacuucucaguauuaccaaaccuaaacugguugaa

SEQ ID NO: 1266 - RNA, 63 nt, Homo sapiens
uaugaaagcaauugguuaggaccucuuuuuuuccucucagggaacuaaugcucugaaaaggga

SEQ ID NO: 1267 - RNA, 61 nt, Homo sapiens
uaugaauaacccacagauguacugaauuacuuuuggugcuaucuuguacucuucaaucugu

SEQ ID NO: 1268 - RNA, 63 nt, Homo sapiens
uaugaggugugggguuuauaagggacugaaucaaaugaauguaacaaaaaagaaaaaaaaaac

SEQ ID NO: 1269 - RNA, 62 nt, Homo sapiens
uaugcauugguuuuuuucccuguaccauacaauucuacuguaacuacccaucaacuuaaaga

SEQ ID NO: 1270 - RNA, 62 nt, Homo sapiens
uaugccaaauauauauugcuauaauacacucaagcaguauuaaucaauaugguaucacaaug

SEQ ID NO: 1271 - RNA, 63 nt, Homo sapiens
uaugcugauaaauguaagauuaguaggaggagaagugaauguaaauuuuauuauagaauuuuc

SEQ ID NO: 1272 - RNA, 64 nt, Homo sapiens
uaugcuuccuuuguuauuugcugauuuuccuacuaaauguagcauuucaauuagauccagcuuu

SEQ ID NO: 1273 - RNA, 62 nt, Homo sapiens
uauggccccucuuaaccaugcugguguuaugauucaguauuaacucucaauuagcaugcccc

SEQ ID NO: 1274 - RNA, 63 nt, Homo sapiens
uauguaaauggcucacaagucaauugcaaacaaacugaauguacaaaucuuagugcuggugcu

SEQ ID NO: 1275 - RNA, 62 nt, Homo sapiens
uauguaagguagggucuuuuuugcauauagacuccaguauuaguuacuuucauucuaaaauu

SEQ ID NO: 1276 - RNA, 61 nt, Homo sapiens
uaugucagaaaaggaugaguuuguggugacaguuggugcuaauaagaauuugccugggcag

SEQ ID NO: 1277 - RNA, 63 nt, Homo sapiens
uaugucuugaacuuuuccucaaagcauuacacuugugaauguauuuuugucuaauagggucga

SEQ ID NO: 1278 - RNA, 63 nt, Homo sapiens
uauguuaauuaauuauauuaaaugucgauucaucuugaauguauucucaauugccuaccaaaa

SEQ ID NO: 1279 - RNA, 64 nt, Homo sapiens
uauguucauuuggagagucagggcgaaagacaggugauguagcacuucuguuuuuaauaauuau

SEQ ID NO: 1280 - RNA, 63 nt, Homo sapiens
uauguuuauguuaacauauuauuagguacuaucuaugaauguauuuaaauauuuuucauauuc

SEQ ID NO: 1281 - RNA, 62 nt, Homo sapiens
uauuaaaauauccagugagcucuuuagaaggacucaguauuauuucaagacuauuuuugagg

SEQ ID NO: 1282 - RNA, 62 nt, Homo sapiens
uauuaaguguacugcagagauaauacgacuucagcaguauuaauagcugauuacuuugcagu

SEQ ID NO: 1283 - RNA, 62 nt, Homo sapiens
uauuaccagcuagccagucacuaggaauuuuuuucaguauuauuuguauguauuaaacuuuu

SEQ ID NO: 1284 - RNA, 63 nt, Homo sapiens
uauuagaauaaaaugugcaaauaaugacaauuauuugaauguaacaaggaauucaacugaaau

SEQ ID NO: 1285 - RNA, 63 nt, Homo sapiens
uauuagucauguauauuuuaaaugcuaacauuugaugaauguaaguuuccacauuguugcugu

SEQ ID NO: 1286 - RNA, 62 nt, Homo sapiens
uauuaugcauucugaauuggaugcauauuccuaacuacuguauuuguuaccaaaagugguuc

SEQ ID NO: 1287 - RNA, 63 nt, Homo sapiens
uauuauuaguuaggcuucugagcuugcaaucauauugaauguaugaagagcgaaaucaaauuc

SEQ ID NO: 1288 - RNA, 63 nt, Homo sapiens
uauuccacuuacuccaccuuccauuccucgcccuguccccacagccgaguccugcaucagccc

SEQ ID NO: 1289 - RNA, 63 nt, Homo sapiens
uauuccccaccaagagauucagggucacagguuuuuccccacaccucugaacucagggccuag

SEQ ID NO: 1290 - RNA, 62 nt, Homo sapiens
uauuccucaugguggcagcgcucauagcgaaagccuacuguaauaugcacccaucucaucca

SEQ ID NO: 1291 - RNA, 63 nt, Homo sapiens
uauucucguaaaacugcgcuuugccaguagcacagugaauguaugccaaaugcaaguccauuc

SEQ ID NO: 1292 - RNA, 62 nt, Homo sapiens
uauucuggaagcgugaauugcuuuugaagucugucaguauuacugguauuuuuaaauaaaga

SEQ ID NO: 1293 - RNA, 62 nt, Homo sapiens
uauucuugguguuuagcuggcucgaugauguuaacaguauuaaaaauuaaaccccauaaacc

SEQ ID NO: 1294 - RNA, 63 nt, Homo sapiens
uauugaacauccccugggcuuacaagaaacacugaugaauguaaaaucaggggacauuugaag

SEQ ID NO: 1295 - RNA, 63 nt, Homo sapiens
uauugauauuggacacauaguacuuuuacauguuuugaauguauugcuaauauuuaaaaauug

SEQ ID NO: 1296 - RNA, 63 nt, Homo sapiens
uauuggcuuguguacaucuauaugcuaaaaugacuuccccacauugacauuugugcgccaccu

SEQ ID NO: 1297 - RNA, 63 nt, Homo sapiens
uauuguauacaagagaugugcaucaguucccacuccucagggacuguaugaauuuggcuuuuu

SEQ ID NO: 1298 - RNA, 64 nt, Homo sapiens
uauuguucaauucaggugaggccugugaugacauauauguagcaugugcucugcgcucccugca

SEQ ID NO: 1299 - RNA, 62 nt, Homo sapiens
uauuuaacgaauaguguggaugugauuugucauccaguauuaaguucuuagucauugauuuu

SEQ ID NO: 1300 - RNA, 63 nt, Homo sapiens
uauuuauuuaaauauuuaaauuuuauauuuauuguugaauguaugguuugcuaccuauuguaa

SEQ ID NO: 1301 - RNA, 64 nt, Homo sapiens
uauuuccaauaauuccaaguucauauagaacugauaauguagcaagccccaaguaugauaauag

SEQ ID NO: 1302 - RNA, 63 nt, Homo sapiens
uauuuggcaggugaguggauggauagauggauaggugaauguagguggacaggugacugggug

SEQ ID NO: 1303 - RNA, 64 nt, Homo sapiens
uauuuuaaaaaggcuuuggcuuaugcugaauuauacauguagcaccaaaauguuacaacucuac

SEQ ID NO: 1304 - RNA, 62 nt, Homo sapiens
uauuuuaauuuuuuaaugucucuguggaguauuuguaugauaccauaauguauauuuaugua

SEQ ID NO: 1305 - RNA, 64 nt, Homo sapiens
uauuuuaugcacuugggagaaggcuuagaauaaaagauguagcacauuuugcuuucccauuuau

SEQ ID NO: 1306 - RNA, 64 nt, Homo sapiens
uauuuugaaaaacacguguugacuccauuguuuuacauguagcaaagucugccaucugugucug

SEQ ID NO: 1307 - RNA, 63 nt, Homo sapiens
uauuuuggauguaaagauuccugugucucauaauaugaauguauuuuuugauauacaagaaac

SEQ ID NO: 1308 - RNA, 62 nt, Homo sapiens
uauuuuucaucuucaaacacaguacaaaaauuaccaguauuaccauaacugagauaaagauc

SEQ ID NO: 1309 - RNA, 61 nt, Homo sapiens
uauuuuuuacacuucucucuuguggcucucuuguggugcuaucuaucuguuuuaaggucuc

SEQ ID NO: 1310 - RNA, 63 nt, Homo sapiens
ucaaaaaucucuuuaauucuuuauauuuuggguuaugaauguauuuucuuggauuuuacugag

SEQ ID NO: 1311 - RNA, 62 nt, Homo sapiens
ucaaaaugacauugcuaaagacugcauuauuuuacuacuguaauuucuccacgacauagcau

SEQ ID NO: 1312 - RNA, 62 nt, Homo sapiens
ucaaagaaaaacaacuuugcuauuucgucauugaguaugauaacacuuaaacuuuacuuacu

SEQ ID NO: 1313 - RNA, 62 nt, Homo sapiens
ucaaagagagucuuuaaacaagcuucauuuuacacuacuguaugcuagcgacggguugugac

SEQ ID NO: 1314 - RNA, 63 nt, Homo sapiens
ucaaauagaugaucuuugacacgauuagacacuccuccccacaaaggcuuugaaaucauaagg

SEQ ID NO: 1315 - RNA, 63 nt, Homo sapiens
ucaacaucaaauuuuuagaauuaaaauacauuuaacucagggaauuuguacuacuuggaaaca

SEQ ID NO: 1316 - RNA, 64 nt, Homo sapiens
ucaacucaacccuucuuccccauuucuugucauagaauguagcauggccauaggugaaaaagcu

SEQ ID NO: 1317 - RNA, 63 nt, Homo sapiens
ucaacuugagcucuugaacuccuccugugggccugugaauguauucauucauuccacaacucu

SEQ ID NO: 1318 - RNA, 63 nt, Homo sapiens
ucaagaaaaaaaaaaaaaaaagaauaugcacagucugaauguauaccaggagugugagagaca

SEQ ID NO: 1319 - RNA, 62 nt, Homo sapiens
ucaagccaauccuuuuugcuguauguuuugcagccuacuguaguagauacgcaacagauaau

SEQ ID NO: 1320 - RNA, 63 nt, Homo sapiens
ucaaguuagugauugcauuugaucccaaaacaagaugaauguaugcaaugggauguacauaag

SEQ ID NO: 1321 - RNA, 63 nt, Homo sapiens
ucaauacccuaccacagauccugccuccacccaguuccccacaaagcaccagagguaggagac

SEQ ID NO: 1322 - RNA, 63 nt, Homo sapiens
ucaauguuuacauuuauguucugcaagacgcuguccucagggaccauuaggggaccauucugu

SEQ ID NO: 1323 - RNA, 63 nt, Homo sapiens
ucacaaacaaacaaaggaggggggagcagguuuuaugaauguaacugugcacaggaaaugacu

SEQ ID NO: 1324 - RNA, 62 nt, Homo sapiens
ucacaaucacgucgguaugauugggcacccuugccuacuguaagagacccuaaaaccuuggu

SEQ ID NO: 1325 - RNA, 63 nt, Homo sapiens
ucacacagaagccuagguagauuuaaaauggggugcucagggacuggggaacaagacggggug

SEQ ID NO: 1326 - RNA, 63 nt, Homo sapiens
ucacagaaauuugugaucugaaaacccggcucccuuccccacaaggcuccugggccuccggga

SEQ ID NO: 1327 - RNA, 63 nt, Homo sapiens
ucaccgacagugaugaggaggaagaagaaaaagugcucagggauuuauaauuuuaaaacaaau

SEQ ID NO: 1328 - RNA, 63 nt, Homo sapiens
ucaccugcuguuuaauagacuuggggccaugugccuccccacacaugggcaaggacaggugga

SEQ ID NO: 1329 - RNA, 63 nt, Homo sapiens
ucaccuggcacccaauguggauacccucaguaagacucagggagccuuauaacuccucuuaac

SEQ ID NO: 1330 - RNA, 63 nt, Homo sapiens
ucacgccggccggggccgcgaggccuggucugagccucagggaggggccccggguccucucag

SEQ ID NO: 1331 - RNA, 63 nt, Homo sapiens
ucacguggcaagccaggcgaggcgggugcugaggucucagggaagcugguaacacuucccugu

SEQ ID NO: 1332 - RNA, 61 nt, Homo sapiens
ucacucacuauugcaaggacagcaucaaagagauggugcuaaaccauucaugaugaacuca

SEQ ID NO: 1333 - RNA, 62 nt, Homo sapiens
ucacugaaauaucucucccuuauggcaauccuagcaguauuaaagaaaaaaggaaacuauuu

SEQ ID NO: 1334 - RNA, 63 nt, Homo sapiens
ucacuggcacugcugacccaucccagaaacacaaucucagggacccgagcagcuccaaggacg

SEQ ID NO: 1335 - RNA, 62 nt, Homo sapiens
ucacuguuucacugaaauguuuggauucucuuagcuacuguaugcaaaguccgauuauauug

SEQ ID NO: 1336 - RNA, 61 nt, Homo sapiens
ucacuuagaaagaugggguuccuguagauuuuuuggugcuaagggauacuuugucauuaug

SEQ ID NO: 1337 - RNA, 63 nt, Homo sapiens
ucacuuccuucagcaucucacuucuucuucuagaauccccacagggaaauacuguauugaaua

SEQ ID NO: 1338 - RNA, 63 nt, Homo sapiens
ucacuuuccaccuagcugauccuaaauguuccuuccucagggaggucuuuucugauuucuugg

SEQ ID NO: 1339 - RNA, 63 nt, Homo sapiens
ucagaauuaaauuuguauagagcagaguuuuaaaaugaauguaaauagcacuaaacguuuucu

SEQ ID NO: 1340 - RNA, 63 nt, Homo sapiens
ucagacacccagaguuggagacagaacaacagagucucagggaaagagaaccacaauagaaaa

SEQ ID NO: 1341 - RNA, 62 nt, Homo sapiens
ucagaccuuagcuugaagcagcuugaggccagaccuacuguagccucagcaucuugcuagga

SEQ ID NO: 1342 - RNA, 63 nt, Homo sapiens
ucagauuuagauucuuccuggggauuacacagcuaugaauguauuugcuucuaaaaccuccca

SEQ ID NO: 1343 - RNA, 63 nt, Homo sapiens
ucagcacugcagcccaaacagugccaacagcccuguccccacaggaccugggagcccugggcc

SEQ ID NO: 1344 - RNA, 63 nt, Homo sapiens
ucagcgcauggucgugcggcaugcccgccgccugcuccccacacggacuccaggcggucccca

SEQ ID NO: 1345 - RNA, 62 nt, Homo sapiens
ucagcguuuucauaaugcaucuucuucccuccuucuacuguacuggauuuaaagcgcaccuu

SEQ ID NO: 1346 - RNA, 61 nt, Homo sapiens
ucagcuauucuuacugacauaccagucuuuagcuggugcuauggucuguucuuuaguucua

SEQ ID NO: 1347 - RNA, 63 nt, Homo sapiens
ucagcucagagagcaccaucccgggggucagggccuccccacaggagcccugcagugugguag

SEQ ID NO: 1348 - RNA, 63 nt, Homo sapiens
ucagcuucccagaguguugugggaaucuuggucauugaauguaaagggacuuaguaaagggua

SEQ ID NO: 1349 - RNA, 62 nt, Homo sapiens
ucaggaaaucuuguaguuuauuguuguuauuuaacaguauuaaguggauuuuuguauauuuc

SEQ ID NO: 1350 - RNA, 63 nt, Homo sapiens
ucaggcaguaguuuauucaucauuugguaagccccuccccacacuccucuaauuuaaacaagu

SEQ ID NO: 1351 - RNA, 63 nt, Homo sapiens
ucaggcuugcccucaccagcggccgucagccgacacucagggauguagcuaacaccacuccgc

SEQ ID NO: 1352 - RNA, 64 nt, Homo sapiens
ucagggaagauaaguuggaaacacuaaauguuaaagauguagcaaacccugucaaacauuagua

SEQ ID NO: 1353 - RNA, 61 nt, Homo sapiens
ucagggaggccgggugugaccucaucuuucucauggugcuauccuggugcuauuggggugg

SEQ ID NO: 1354 - RNA, 63 nt, Homo sapiens
ucagggcccagaccuuccugcucuccagcaggggauccccacaaccucacacuugucuguucu

SEQ ID NO: 1355 - RNA, 63 nt, Homo sapiens
ucaggguggggcaacaguggcaucaggugcggggccucagggaaauacaucuuuagugaacgc

SEQ ID NO: 1356 - RNA, 63 nt, Homo sapiens
ucagguggacuuugcaaggacugauggauagcuaccucagggaccagaauccgugggaaggga

SEQ ID NO: 1357 - RNA, 62 nt, Homo sapiens
ucagguucugugcucuuuuuggagucuuuaagcucaguauuagucuauugcagcuaucucgu

SEQ ID NO: 1358 - RNA, 63 nt, Homo sapiens
ucaguccaucucccucaucuccauucucaguuucuuccccacaaaauuuggaaucaaagcuuu

SEQ ID NO: 1359 - RNA, 63 nt, Homo sapiens
ucagucccaggugaggccaagggcuuucuggccaucucagggaggggccaccagguuccuccc

SEQ ID NO: 1360 - RNA, 63 nt, Homo sapiens
ucagugguucagagccugguuauacauauagaucacucagggagcuuuggaaaaauaaagauu

SEQ ID NO: 1361 - RNA, 63 nt, Homo sapiens
ucagugucggggcugagccccuugagcugcuucagugaauguacagugcccggcacgagcuga

SEQ ID NO: 1362 - RNA, 63 nt, Homo sapiens
ucaguguuuugggucuaggugagagcaggccccucuccccacaccucgccccacagagcucug

SEQ ID NO: 1363 - RNA, 64 nt, Homo sapiens
ucaguucuggcucugccuagcuguuuacauuugcaaauguagcaaacaagguaaugaagcaacu

SEQ ID NO: 1364 - RNA, 63 nt, Homo sapiens
ucaguugacugguuuuguguccuguuugaacuugcugaauguaaggcaggcuacuaugcguua

SEQ ID NO: 1365 - RNA, 61 nt, Homo sapiens
ucaguuuaaucagaaaaagacauaccaaguagcuggugcuaauuauuauaagacuaacauu

SEQ ID NO: 1366 - RNA, 63 nt, Homo sapiens
ucaguuuucuuuuuuauuuugguuaugcuuaaauaugaauguaauuaccaaaagauuuagaag

SEQ ID NO: 1367 - RNA, 63 nt, Homo sapiens
ucaguuuuuccaaagucaagagucuuaaccuuguacucagggaauuuugagauaacaaguccc

SEQ ID NO: 1368 - RNA, 63 nt, Homo sapiens
ucauaaacgcgauuugcaaaaacaaggagccuuagugaauguacaguaccuagacuucugugu

SEQ ID NO: 1369 - RNA, 62 nt, Homo sapiens
ucauagcuuguuuuauuuugugcuauaaaauuaacaguauuaaaugacuuauauucuuagaa

SEQ ID NO: 1370 - RNA, 62 nt, Homo sapiens
ucauauaucuugaacucaauaucucagaucucuucuacuguauuacugaauagcauacauac

SEQ ID NO: 1371 - RNA, 63 nt, Homo sapiens
ucaucacagauccaaacagaaaaaugggggcgauguccccacauggagggaacacccgacuua

SEQ ID NO: 1372 - RNA, 61 nt, Homo sapiens
ucaucacuucuucagccaucucacugaaguccuuggugcuagcugggcuuuugugacaacu

SEQ ID NO: 1373 - RNA, 64 nt, Homo sapiens
ucauccucucugugccaccucuccacccaggaggccauguagcauaguggaaaaagucccugag

SEQ ID NO: 1374 - RNA, 62 nt, Homo sapiens
ucaugaacuuugagaaugggcuuccuuuuugguucaguauuagugagagggagagggagaug

SEQ ID NO: 1375 - RNA, 63 nt, Homo sapiens
ucaugccuggggcguccucccuggagcugggggagcucagggacccccaggucuguguggcug

SEQ ID NO: 1376 - RNA, 61 nt, Homo sapiens
ucaugugaucucugggaaaaaaauaugcugccuuggugcuaauauuguauguauuuaaaug

SEQ ID NO: 1377 - RNA, 62 nt, Homo sapiens
ucauguuccuuuugaaauuguagugcaaaauggucaguauuaucuaaaugaaugagccaaaa

SEQ ID NO: 1378 - RNA, 63 nt, Homo sapiens
ucauuagggcuugcagacaaugucaccuaaauugcugaauguacucauuauaauaugauaucu

SEQ ID NO: 1379 - RNA, 62 nt, Homo sapiens
ucauucguaccaugccaaacgcauucacucggggcaguauuaaccguucuagaaagccacug

SEQ ID NO: 1380 - RNA, 64 nt, Homo sapiens
ucauuguacuaccuguguauauaguuuuuaccuuuuauguagcacauaaacuuuggggaaggga

SEQ ID NO: 1381 - RNA, 62 nt, Homo sapiens
ucauuguuuucuauuuguauuauaauacacgugccuacuguauacucaacaguccucuagag

SEQ ID NO: 1382 - RNA, 62 nt, Homo sapiens
ucauuuaaucuuuacuacacuccugcaacauagacaguauuauuacauucaguauuacaaug

SEQ ID NO: 1383 - RNA, 63 nt, Homo sapiens
ucauuugccuucccuaccucuuccucccagaguccuccccacaguuccuaagggccacugugu

SEQ ID NO: 1384 - RNA, 62 nt, Homo sapiens
ucauuuugcuauuggaauuuuuuauuguaacauuguaugauaaccugaaauguuuacuugug

SEQ ID NO: 1385 - RNA, 62 nt, Homo sapiens
uccaaacugauuaaguuacaguuuaagcacccuucaguauuaauauauacgguauuauauaa

SEQ ID NO: 1386 - RNA, 62 nt, Homo sapiens
uccaaucugugauuaaaaguguaaacuauagacucuacuguaguacauuucaggaucuagaa

SEQ ID NO: 1387 - RNA, 63 nt, Homo sapiens
uccacggggcuccuuucccuccgaagggcugcucuuccccacaggcgcggggacagcagcccg

SEQ ID NO: 1388 - RNA, 63 nt, Homo sapiens
uccagcaggagcagauccaggagcagcucauaugauccccacagucgauccagguccuacacc

SEQ ID NO: 1389 - RNA, 63 nt, Homo sapiens
uccagccgacgaagaguaggaaaagagaagggcugcucagggaaacauuggcugggggcacgg

SEQ ID NO: 1390 - RNA, 62 nt, Homo sapiens
uccaggacaaacuccgccuccccuuaguggaaaccaguauuaacccagagguuugggcaacu

SEQ ID NO: 1391 - RNA, 63 nt, Homo sapiens
uccagggaugggcucugaugagaggguaaaagaugcucagggaaacacaggccucagcugccu

SEQ ID NO: 1392 - RNA, 62 nt, Homo sapiens
uccaguaaaauaacagcaaugacaaugagaucgucaguauuauuuucacauuucccugagag

SEQ ID NO: 1393 - RNA, 64 nt, Homo sapiens
uccaguguugccuccucccauccagcgucugcgcggauguagcauguucuauguguuuuuaaac

SEQ ID NO: 1394 - RNA, 62 nt, Homo sapiens
uccaguuauuagcaaacucagacgaauguaccgccaguauuaucagcagucaacaagcaccu

SEQ ID NO: 1395 - RNA, 63 nt, Homo sapiens
uccaucaggcccuauuggccucuguuagacauugacucagggagccggagcgccaaguggagg

SEQ ID NO: 1396 - RNA, 62 nt, Homo sapiens
uccaucauguuuuaacauacuguauacucuauagcaguauuacagucaguauuucauauaau

SEQ ID NO: 1397 - RNA, 64 nt, Homo sapiens
uccauguguggacucaaguccuuaccucuuccggagauguagcaaaacgcauggaguguguauu

SEQ ID NO: 1398 - RNA, 64 nt, Homo sapiens
uccauuaauguagauaaagcacuguuuggauaugagauguagcaaauuccaauacauuauugga

SEQ ID NO: 1399 - RNA, 62 nt, Homo sapiens
uccauuugcuacugccuagucuugguuccuuaugcaguauuauagggcagccuuuuuagagc

SEQ ID NO: 1400 - RNA, 63 nt, Homo sapiens
ucccaaaagcacacaagcacauacagacauaugcauccccacacacgccuaugcacaaacgug

SEQ ID NO: 1401 - RNA, 64 nt, Homo sapiens
ucccaaaccccacacagaauacucugccucuguuucauguagcaaaugagcaaaaacucaguau

SEQ ID NO: 1402 - RNA, 63 nt, Homo sapiens
ucccacauugugucaagucugcccauggcccacccuccccacaguccaaaaccacacagcccu

SEQ ID NO: 1403 - RNA, 63 nt, Homo sapiens
ucccaggccuagagaggaaaaucagcagagccucgugaauguauuucucguggcaagaaggga

SEQ ID NO: 1404 - RNA, 63 nt, Homo sapiens
uccccugccucuguuagugguuaacacucuuuucccucagggagccuaaugagguuuuuaaua

SEQ ID NO: 1405 - RNA, 63 nt, Homo sapiens
uccccuucgaggauugcacccgcccguccuaagccuccccacaaggcgaggggaguuaccccu

SEQ ID NO: 1406 - RNA, 64 nt, Homo sapiens
ucccgggcccagguaguccucccaccucagccucccauguagcaggaaccacaggcaggcacca

SEQ ID NO: 1407 - RNA, 63 nt, Homo sapiens
ucccuccccugacucccaccuugguagggugcugccucagggagccauagaagucggcugugu

SEQ ID NO: 1408 - RNA, 63 nt, Homo sapiens
ucccuccuaaccccuuggugccuuucccagggggauccccacacuggucuugccucuucuuuu

SEQ ID NO: 1409 - RNA, 63 nt, Homo sapiens
ucccugagaaggugucaccuuaucuguccuccucuuccccacacacuggccucuggguccccc

SEQ ID NO: 1410 - RNA, 61 nt, Homo sapiens
ucccuggcugccugugaauggcccacauuugaguggugcuaacuugaugugaguaggcauu

SEQ ID NO: 1411 - RNA, 63 nt, Homo sapiens
ucccuuccagcuuuucuguagaaucuuacugguauugaauguaaaggaagcaaggccuguauu

SEQ ID NO: 1412 - RNA, 63 nt, Homo sapiens
ucccuuucucacuguugccuguccccuaacucaccuccccacagccccuauccuuucccccuc

SEQ ID NO: 1413 - RNA, 63 nt, Homo sapiens
uccgacgcuggcgggacacaggcgucgccuuugaacucagggacuccagcgccuaucaugugc

SEQ ID NO: 1414 - RNA, 63 nt, Homo sapiens
uccggggugcucagaaguuuuaggagggaaugagccucagggaggagugagcaccuaaaugaa

SEQ ID NO: 1415 - RNA, 63 nt, Homo sapiens
uccuaguaagugccacuuccacuaagaauacaguuugaauguauaaucaguaguguuuacaag

SEQ ID NO: 1416 - RNA, 63 nt, Homo sapiens
uccucauccccacguccucucguccccuugucccguccccacauacccucguccccauguccc

SEQ ID NO: 1417 - RNA, 63 nt, Homo sapiens
uccucccccuacuucuccccaagggccaagaacugcucagggacauuaaaggucaaaagucca

SEQ ID NO: 1418 - RNA, 62 nt, Homo sapiens
uccucuguuuucuuuuuaauauacauuuaaaauacaguauuaucacuuuauaaaacauacau

SEQ ID NO: 1419 - RNA, 63 nt, Homo sapiens
uccucuugucaagguuugggaaugucaaagcccccuccccacacagggccuuuccugucccuu

SEQ ID NO: 1420 - RNA, 63 nt, Homo sapiens
uccugagacaggccagcuuggauggccuccagcaacucagggauaacaugggcuccaggaggg

SEQ ID NO: 1421 - RNA, 63 nt, Homo sapiens
uccugggggcgggguugugggggggcugagcgacacucagggacaccucaguuguccucccgc

SEQ ID NO: 1422 - RNA, 63 nt, Homo sapiens
uccuguagcugucaguuugauuccugugaguagggcucagggauuuaucuuguuaccaaugug

SEQ ID NO: 1423 - RNA, 63 nt, Homo sapiens
uccugucaggaccucuggcccuacuaggcuguagacucagggagagcacagucuggcugugcu

SEQ ID NO: 1424 - RNA, 64 nt, Homo sapiens
uccuugaggcacaggaguuccagaccagccugggcaauguagcaagacgcugucucuauuuaua

SEQ ID NO: 1425 - RNA, 62 nt, Homo sapiens
uccuugcugggguuucuacaguccccaacgugaacaguauuaagcaagagguggacucgagc

SEQ ID NO: 1426 - RNA, 63 nt, Homo sapiens
uccuuggaugaaaacccguauaguucacaauagagcucagggagccccuaacucuuccaaacc

SEQ ID NO: 1427 - RNA, 63 nt, Homo sapiens
uccuuguuugcugaggggugggagccacccagcgucucagggaccugucccuccgucacgucg

SEQ ID NO: 1428 - RNA, 62 nt, Homo sapiens
uccuuuccuggcugugacccgccacacucacugucaguauuaaggcccagcagccuguugau

SEQ ID NO: 1429 - RNA, 62 nt, Homo sapiens
uccuuuucaugaaaacuucucaauuuaauuuuaacuacuguaggauaguauugauugaaugg

SEQ ID NO: 1430 - RNA, 63 nt, Homo sapiens
uccuuuucccucucaccuaaaugucaacuugucauugaauguaaagaaugaaaccuucugaca

SEQ ID NO: 1431 - RNA, 63 nt, Homo sapiens
ucgauaguuaauuauagacuuugguaccuuugugccucagggaagccacgugauauaacuggu

SEQ ID NO: 1432 - RNA, 61 nt, Homo sapiens
ucgauccugaagaucgugugaaggaagcguucuuggugcuacacacagucuggaaaagcag

SEQ ID NO: 1433 - RNA, 62 nt, Homo sapiens
ucgaugguuucuucuauacaccuuuuugguugaccaguauuacuauacaauguaaguguuuu

SEQ ID NO: 1434 - RNA, 62 nt, Homo sapiens
ucgccuuugcagaaccaccugggccccuuucugucaguauuauuaggguuacgaauugcagc

SEQ ID NO: 1435 - RNA, 63 nt, Homo sapiens
ucggagggaaauuguaaauccuguguuucauuacuugaauguaguuaucuauugaaaauauau

SEQ ID NO: 1436 - RNA, 63 nt, Homo sapiens
ucggaguuuacguguugcaccuuuucacagacgguuccccacagcauccucagacagcucugu

SEQ ID NO: 1437 - RNA, 63 nt, Homo sapiens
ucggcacugcccccggccuuccaugagaagccgacuccccacaccgaguuuuaaagcaaagcc

SEQ ID NO: 1438 - RNA, 63 nt, Homo sapiens
ucggugugaggcugcagugggugggggauggauccuccccacacaucugaggacacacaacca

SEQ ID NO: 1439 - RNA, 63 nt, Homo sapiens
ucgguuauuacacaauaaucuauuucagcuucucaugaauguacaaaguagacuuucuuacaa

SEQ ID NO: 1440 - RNA, 62 nt, Homo sapiens
ucguaggauguauacagacuuauuuucuuuauuacaguauuauaagaaaacauauguauuug

SEQ ID NO: 1441 - RNA, 63 nt, Homo sapiens
ucgugaacagccacauauccuugcaccugacacuguccccacacaaauagcuggcuuucguug

SEQ ID NO: 1442 - RNA, 63 nt, Homo sapiens
ucguguugcagauggcagccuuuucuccuucauuuuccccacauuuucucuggcccucuaccu

SEQ ID NO: 1443 - RNA, 64 nt, Homo sapiens
ucguuugaggccaggaguuugagaccagccugggcaauguagcaagacucugucucugcaaaaa

SEQ ID NO: 1444 - RNA, 62 nt, Homo sapiens
ucuaaaaaggugaaacuuuggcuguugaaaguuucaguauuaguaaacuugaguuacuuuuu

SEQ ID NO: 1445 - RNA, 63 nt, Homo sapiens
ucuaaagauuucaaauaguggcagacagugucuucugaauguaaguuuugagaaauacgaguc

SEQ ID NO: 1446 - RNA, 62 nt, Homo sapiens
ucuaaagugcucuuaugagagacuugugggccaucaguauuagugauuucauacugcagugc

SEQ ID NO: 1447 - RNA, 62 nt, Homo sapiens
ucuaacuucagcuucacugacacuggguugagcacuacuguauguggaggguuuggugauug

SEQ ID NO: 1448 - RNA, 62 nt, Homo sapiens
ucuaaguguuggcuuuaaagugaauuuaucuuuaguaugauaguuauaugaaaauuauagga

SEQ ID NO: 1449 - RNA, 63 nt, Homo sapiens
ucuaaugaguggucggaccguggggaagggccccacucagggaucucagaccuagugcucccu

SEQ ID NO: 1450 - RNA, 62 nt, Homo sapiens
ucuaauuuuuacaacaguagaacuuccuccuuuucuacuguaaucuucccacugacuuuacu

SEQ ID NO: 1451 - RNA, 63 nt, Homo sapiens
ucuacacuguaaguuuuaaacguuacguuucuguaugaauguaguguggguuugaguagcauu

SEQ ID NO: 1452 - RNA, 62 nt, Homo sapiens
ucuagauccuagauauuagaauaaaauuuauuuucuacuguauccauuucaaauguuaaaau

SEQ ID NO: 1453 - RNA, 63 nt, Homo sapiens
ucuaggaaaggggguggagacaggaccgugacagucucagggaccaaucccugccucugccca

SEQ ID NO: 1454 - RNA, 63 nt, Homo sapiens
ucuaggcaucauguccuauaguuugucaucccugaugaauguaaaguuacacuguucacaaag

SEQ ID NO: 1455 - RNA, 63 nt, Homo sapiens
ucuaggcugugugaaccagcccaagaugaccaacauccccacaccucuacaucucuguccccu

SEQ ID NO: 1456 - RNA, 61 nt, Homo sapiens
ucuaguuguuuuuauguaguacacacauuuuaauggugcuaacaaccugggcucuuuuguu

SEQ ID NO: 1457 - RNA, 63 nt, Homo sapiens
ucuauacacuaucaaauauauaaagcuuucuauauugaauguacauuauacagaucauucaua

SEQ ID NO: 1458 - RNA, 64 nt, Homo sapiens
ucuauacuccacagagagcuuuuuaaguaaugaauuauguagcacuauuuuggguggaugaguu

SEQ ID NO: 1459 - RNA, 63 nt, Homo sapiens
ucuauacucccugcacccuucugacugacaguucauccccacaaaacacauugguuuugagag

SEQ ID NO: 1460 - RNA, 63 nt, Homo sapiens
ucuaucagaaauuguaagagaauagauacauguuuugaauguaaaguugaaaagucugguuua

SEQ ID NO: 1461 - RNA, 63 nt, Homo sapiens
ucuaugccuuggagcuccugacugcagggacucuguccccacacucaaaaagacucagcucac

SEQ ID NO: 1462 - RNA, 61 nt, Homo sapiens
ucuaugugaugggugggguggggagggaaucacuggugcuauagaaauugagaugcccccc

SEQ ID NO: 1463 - RNA, 63 nt, Homo sapiens
ucuauuaccaauuuuucagaacucauagauaaauaugaauguagggaagcuguaagccagccc

SEQ ID NO: 1464 - RNA, 63 nt, Homo sapiens
ucuauuauuauuggcuccuucugggaagaaccaagugaauguagggguugaaggaacacauac

SEQ ID NO: 1465 - RNA, 64 nt, Homo sapiens
ucuauucccuuuggacauacaugcuacagucccacaauguagcauuuccuuggaaacucccuuu

SEQ ID NO: 1466 - RNA, 63 nt, Homo sapiens
ucuauuuuaaguauauuauuuauuguuggcaguuccucagggauuucccuuuucucuguauug

SEQ ID NO: 1467 - RNA, 61 nt, Homo sapiens
ucucaccucccaccaauuucuccuuucuccauauggugcuaaaaccucaaagcugaggagg

SEQ ID NO: 1468 - RNA, 63 nt, Homo sapiens
ucucaccucugcuccagaaauaaaugccugacaccuccccacaaccugcaaucugucgggcac

SEQ ID NO: 1469 - RNA, 63 nt, Homo sapiens
ucucagaagucaagcugauggaguaugugauaaagugaauguacauguauauacacacacacc

SEQ ID NO: 1470 - RNA, 62 nt, Homo sapiens
ucuccugaugcauuuguaaacaagaagguuucagcaguauuacaccaccucccucaugccuc

SEQ ID NO: 1471 - RNA, 63 nt, Homo sapiens
ucuccuucaagacccaacugagcacccgcucugauuccccacagccuuucucccugccaccac

SEQ ID NO: 1472 - RNA, 63 nt, Homo sapiens
ucucugagcugcuucugcaaaggcccccaugucccuccccacaccggcccugggcauagccuc

SEQ ID NO: 1473 - RNA, 64 nt, Homo sapiens
ucucugccugugauuuucuuuucuaaaugaaacuccauguagcaaccaggacgaaguugagaag

SEQ ID NO: 1474 - RNA, 62 nt, Homo sapiens
ucucuggcuuguuuuuuuguuuuucccagaaaaucaguauuauuuuuuaaauaagaaaaaca

SEQ ID NO: 1475 - RNA, 61 nt, Homo sapiens
ucucuugauuugaccucagugcuuugaauucacuggugcuacaauauguaacugugguuaa

SEQ ID NO: 1476 - RNA, 63 nt, Homo sapiens
ucugacucuucagcaagcagcaaaugaccuaguaacucagggacaacuauuuuugaacuuuaa

SEQ ID NO: 1477 - RNA, 63 nt, Homo sapiens
ucugagagcuagccagaacugggguacagccugggcucagggaauagcugucaacacucgggc

SEQ ID NO: 1478 - RNA, 62 nt, Homo sapiens
ucugagauugucagcccuuugucuaaaauaauggcaguauuaaugauugacuucugucacug

SEQ ID NO: 1479 - RNA, 63 nt, Homo sapiens
ucugcaguccugccucugccacagucucucuguuguccccacaucuacccaacuuccuguacu

SEQ ID NO: 1480 - RNA, 64 nt, Homo sapiens
ucugccaccugccuugaaagggucuccagcugccauauguagcauuggaguccucugcaaugcg

SEQ ID NO: 1481 - RNA, 63 nt, Homo sapiens
ucugccccauccuggauggaggacgaggggagcaacucagggaaacagaggccuagagaggcu

SEQ ID NO: 1482 - RNA, 62 nt, Homo sapiens
ucugcccuugaagguaucuucuccaggaaauuagcaguauuauuuucacuucuaagcaaaca

SEQ ID NO: 1483 - RNA, 63 nt, Homo sapiens
ucugccugcccuccagccccaucaccagcuucuugcucagggagacuuccgcccuccucacug

SEQ ID NO: 1484 - RNA, 63 nt, Homo sapiens
ucugccuuugaaaaugcuuccaaaaguagacccuguccccacacaggucaagacuacagagaa

SEQ ID NO: 1485 - RNA, 62 nt, Homo sapiens
ucuggaaacauaugugagacacucagaguaaugucuacuguauccagcuaucuuucuuggau

SEQ ID NO: 1486 - RNA, 63 nt, Homo sapiens
ucuggaaguguauugggcugaggugggauuuucccuccccacagugcacugagcaauggaggg

SEQ ID NO: 1487 - RNA, 64 nt, Homo sapiens
ucuggggagcaagcccuuacuugcucagcacugguuauguagcacaaauagcuccuaggaaaau

SEQ ID NO: 1488 - RNA, 62 nt, Homo sapiens
ucugggggccaaaggucaguggcaggggguauuucaguauuauacaacugcugugaccagac

SEQ ID NO: 1489 - RNA, 63 nt, Homo sapiens
ucuggggucugugauggggaaggguggaugucccuuccccacaauaggcuuagugcuuggcuc

SEQ ID NO: 1490 - RNA, 63 nt, Homo sapiens
ucuggguguguggauuuccuucagcuacccggauguccccacaggcaaucugauuuuuucucc

SEQ ID NO: 1491 - RNA, 62 nt, Homo sapiens
ucuguaaggcugguauuuuugucuguuuuaucuucuacuguaucgccagugccuggaacagu

SEQ ID NO: 1492 - RNA, 63 nt, Homo sapiens
ucugugcuucaguuucccauggcuggaauacuuaccucagggacauaugcagauccaaagacc

SEQ ID NO: 1493 - RNA, 63 nt, Homo sapiens
ucuguuuauuuuuuauucuaaguacacugauucugugaauguaccuuuuuuauuaacagggaa

SEQ ID NO: 1494 - RNA, 62 nt, Homo sapiens
ucuuaaaaaugaaagguuggaaauuaacuuuaugcuacuguaccaccuucgaaguauuucug

SEQ ID NO: 1495 - RNA, 63 nt, Homo sapiens
ucuuaucaggcauuuucauuuggaaauuucauuauugaauguagcaagguuguaguuguuuuu

SEQ ID NO: 1496 - RNA, 62 nt, Homo sapiens
ucuucaccuuuuccuguauuuguacauagugauucaguauuagagaaaagugcauuguuucu

SEQ ID NO: 1497 - RNA, 62 nt, Homo sapiens
ucuucagauuugcagucuggggaagacacagccucuacuguacuuuagaaccugagauaugg

SEQ ID NO: 1498 - RNA, 63 nt, Homo sapiens
ucuuccugaucucuuacagcucuaccuggggccaacucagggaccugagagggcacauucaca

SEQ ID NO: 1499 - RNA, 63 nt, Homo sapiens
ucuucucucuucauuccucuuaggagagugccaaacucagggacccagcacugggcuggguug

SEQ ID NO: 1500 - RNA, 62 nt, Homo sapiens
ucuucugucagacccugugaccugcgagcugcuacuacuguaaggagggaaauggaugaauc

SEQ ID NO: 1501 - RNA, 63 nt, Homo sapiens
ucuucuguuugugaagaaaaaaacaaguuaaaaacugaauguacugauuuagaaaauauauau

SEQ ID NO: 1502 - RNA, 61 nt, Homo sapiens
ucuugaacaguugcaaucuuggcagcuugaaaauggugcuacacucuguuuugugugccuu

SEQ ID NO: 1503 - RNA, 63 nt, Homo sapiens
ucuugacuuuccugguuauagcuuuccaucacagcuccccacauucucucuugauguugaaag

SEQ ID NO: 1504 - RNA, 63 nt, Homo sapiens
ucuugcaccaguauuucaggaacaucugcuugccauccccacagcucuuuaaaacuggcuauu

SEQ ID NO: 1505 - RNA, 63 nt, Homo sapiens
ucuugcacuuuaaaaacgcugcguccuauuccauuugaauguaaauucuuaaaaguugagacc

SEQ ID NO: 1506 - RNA, 62 nt, Homo sapiens
ucuuggacuauguauuugacauguaaaauauguacaguauuaacgucaaccaucucuuuaaa

SEQ ID NO: 1507 - RNA, 62 nt, Homo sapiens
ucuuggauuuuuaaaccacagucuggagugauagcuacuguagaaaggaaauagacuuugua

SEQ ID NO: 1508 - RNA, 62 nt, Homo sapiens
ucuuguuucaggaaugguuaauucuucaacguugguaugauaaugauaacuuguuuugacuu

SEQ ID NO: 1509 - RNA, 62 nt, Homo sapiens
ucuuuacaacuguuuaaucaguuuuauuuuuguacaguauuagugaccuaaguuauuuugcu

SEQ ID NO: 1510 - RNA, 63 nt, Homo sapiens
ucuuugaaccgcgacuacuggaaguggccuuugcucucagggaacauggugauggaggguugc

SEQ ID NO: 1511 - RNA, 63 nt, Homo sapiens
ucuuugagggaggggagcuaugcuaggacuccaaccucagggacucggguggccugcgcuagc

SEQ ID NO: 1512 - RNA, 62 nt, Homo sapiens
ucuuuguaauuagaagcuucagaacucacuaauacuacuguaccuuucauuggcgcauuacc

SEQ ID NO: 1513 - RNA, 63 nt, Homo sapiens
ugaaaacaaaauuagagcaaagcugaccuggagcccucagggagcaaaacaucaucuccaccu

SEQ ID NO: 1514 - RNA, 63 nt, Homo sapiens
ugaaaagagggugcagaguccaggccagauagucuuccccacacacuuucaucucguuuccuc

SEQ ID NO: 1515 - RNA, 63 nt, Homo sapiens
ugaaaggauaaaauauuucuguaaugauuaugauucucagggauuggggaaagguucacagaa

SEQ ID NO: 1516 - RNA, 62 nt, Homo sapiens
ugaaauacuuauuaagcugcuaugaaugguaacaguaugauaaaauucaugcuguuauuagg

SEQ ID NO: 1517 - RNA, 63 nt, Homo sapiens
ugaaauccaguugccauugaguagcaaagccacgcuccccacaggacuuggacagagggccca

SEQ ID NO: 1518 - RNA, 63 nt, Homo sapiens
ugaaauuaucuauuuucuauagauuuuaguacuauugaauguauuacuuuacuguuaccugaa

SEQ ID NO: 1519 - RNA, 64 nt, Homo sapiens
ugaacaagaccaaguauacaucuccauuagauuaaaauguagcacaggguuaaaaauuaucagu

SEQ ID NO: 1520 - RNA, 63 nt, Homo sapiens
ugaacaaucauuaauucuucgauauuucuguagcuugaauguaacugcuuuaagaaagguucu

SEQ ID NO: 1521 - RNA, 63 nt, Homo sapiens
ugaacauugcucuucauuuuggccuguacuucucccucagggacguagaacaauggaauguca

SEQ ID NO: 1522 - RNA, 63 nt, Homo sapiens
ugaacgcgggucgguguggagucagugacugcugacucagggagcuccuuggccccgugggca

SEQ ID NO: 1523 - RNA, 63 nt, Homo sapiens
ugaacuggccuuacuuugauuuuuaaaacaagagacucagggaaaguacuaaaccaaaaucuc

SEQ ID NO: 1524 - RNA, 61 nt, Homo sapiens
ugaagaccuguuauguagaggaaauacgagggguggugcuagaagacagacaucuguggaa

SEQ ID NO: 1525 - RNA, 63 nt, Homo sapiens
ugaagaguuucaguagaguggccccagggugauagcucagggaacaacaaaaaaggaauuccg

SEQ ID NO: 1526 - RNA, 61 nt, Homo sapiens
ugaagcucauuucucccagagauuuuguggacuuggugcuagucaagagauaugaggaugg

SEQ ID NO: 1527 - RNA, 63 nt, Homo sapiens
ugaaggacagggaacucuccauuauuggggcaggacucagggaggacacuuggggccaugugu

SEQ ID NO: 1528 - RNA, 61 nt, Homo sapiens
ugaagggaggccggggcuacgaccgggaccacguggugcuaugggagccggaugaggacag

SEQ ID NO: 1529 - RNA, 61 nt, Homo sapiens
ugaauaaucauuagccaaagaucaacucucuaauggugcuaauggcaaucuagcuaaugug

SEQ ID NO: 1530 - RNA, 62 nt, Homo sapiens
ugaauccacaggcauaaagcacuccccauuuuuccuacuguaaugcagauucuccggcucaa

SEQ ID NO: 1531 - RNA, 63 nt, Homo sapiens
ugaauuccacuguuaccugaccauguauauucagaugaauguacucuuucuuguuccuuguua

SEQ ID NO: 1532 - RNA, 59 nt, Homo sapiens
ugacaagaaaugcaguuaaaaaaccaaauuucaguauuauuggugccaacaugucuauc

SEQ ID NO: 1533 - RNA, 62 nt, Homo sapiens
ugacaggccugaagauauuacuacuuaccauuugcuacuguacauaaacaaugaugcccugc

SEQ ID NO: 1534 - RNA, 63 nt, Homo sapiens
ugacaguugaaggccucgcuuaguuguacuggauucucagggagcccucuguggccuuuugcu

SEQ ID NO: 1535 - RNA, 63 nt, Homo sapiens
ugacauagaguaaacaucuuaguaauauauuaaagugaauguaaauggugguuaaaauuacau

SEQ ID NO: 1536 - RNA, 63 nt, Homo sapiens
ugacaugugauggugauagucucugguucuccccauccccacaaaggcuguugaaccacagca

SEQ ID NO: 1537 - RNA, 63 nt, Homo sapiens
ugaccacuucugugccaguugucuaagcagagcgccucagggacgcuggaaaugccuuaagga

SEQ ID NO: 1538 - RNA, 63 nt, Homo sapiens
ugaccauagcuccuucucucuuacauugaauguagagaauguagccauuguagcagcuugugu

SEQ ID NO: 1539 - RNA, 63 nt, Homo sapiens
ugacccuuccuuuuuaccucauuuauuugguacuuuccccacacaguccuuuauccaccugga

SEQ ID NO: 1540 - RNA, 62 nt, Homo sapiens
ugaccuuaaugggaagaacagaaaaauuuaguugcuacuguagauuuacaugauuaagaggc

SEQ ID NO: 1541 - RNA, 62 nt, Homo sapiens
ugacuauguuagauuauuuuuaaagaugaaacauguaugauaggauggauucuuucuguauu

SEQ ID NO: 1542 - RNA, 63 nt, Homo sapiens
ugacucuccaaaugccagauuuuccuccuccuugccucagggaagugaagggcagccgauagc

SEQ ID NO: 1543 - RNA, 63 nt, Homo sapiens
ugacuuuccucucccaguuuccagacagggcucuuugaauguaugucaaacucaguuacucca

SEQ ID NO: 1544 - RNA, 63 nt, Homo sapiens
ugagaacagcaguuuauuacucacuaaagacagaaugaauguagaaaaggcugaauucuguaa

SEQ ID NO: 1545 - RNA, 62 nt, Homo sapiens
ugagaagauucgcccuguaccccaaaccccuuuccaguauuacccuuaaugcuugagaaccu

SEQ ID NO: 1546 - RNA, 62 nt, Homo sapiens
ugagaauauuuuuauuuucugaaggcagagauaucuacuguauaauugcaccaaaguacauu

SEQ ID NO: 1547 - RNA, 63 nt, Homo sapiens
ugagacauaaucuaccuuaaauagugcauuuuuuucucagggaauuuuagaugaacuugaaua

SEQ ID NO: 1548 - RNA, 62 nt, Homo sapiens
ugagacauuuguugagaauauucuauuuggugcucuacuguauuuuucuuuuuaauaucuac

SEQ ID NO: 1549 - RNA, 63 nt, Homo sapiens
ugagacuaacuuuguauguuaagguuugaacuaagugaauguaucugcagaggaaguauuaca

SEQ ID NO: 1550 - RNA, 64 nt, Homo sapiens
ugagacucccucucaaaaaaagaaaaaagccccagcauguagcaaaagcauuucuuggugagug

SEQ ID NO: 1551 - RNA, 63 nt, Homo sapiens
ugagagggggcucacaagugaccgauccugggugccucagggagcucacugagggcgugcaaa

SEQ ID NO: 1552 - RNA, 63 nt, Homo sapiens
ugagaguuguauguaaccagugauaugauuauuccugaauguacagacagaaguaagccugga

SEQ ID NO: 1553 - RNA, 63 nt, Homo sapiens
ugagcucuccagcuuggaccacacauugcccuuuucucagggaaggaaauggaaacaaaaagc

SEQ ID NO: 1554 - RNA, 63 nt, Homo sapiens
ugagcucuuccccaugcuugggacacguuccuugguccccacagcagaauggacauugaauuu

SEQ ID NO: 1555 - RNA, 53 nt, Homo sapiens
ugaggaagaugacaaguaaccuccccucagggauacgacacaugcccaugaug

SEQ ID NO: 1556 - RNA, 63 nt, Homo sapiens
ugaggcaggucacaugcaacaaauugugacccugcuccccacaagucaugcaaagguuuugaa

SEQ ID NO: 1557 - RNA, 61 nt, Homo sapiens
ugaggccacagguccaccuagggcggcagaugcuggugcuauuugucacgacuuuugccaa

SEQ ID NO: 1558 - RNA, 63 nt, Homo sapiens
ugaggcccuacuuuuuggucgcccagggugagagcugaauguaggcuccaacaggaagacggc

SEQ ID NO: 1559 - RNA, 63 nt, Homo sapiens
ugaggucaugaggacuagauucuagagcuacaggucucagggacagucucgagggauacaggg

SEQ ID NO: 1560 - RNA, 63 nt, Homo sapiens
ugaggugggauggccccaucuggauguucugcagauccccacaugggaggagauucccaagua

SEQ ID NO: 1561 - RNA, 64 nt, Homo sapiens
ugaguauuacuucccuuugcaauguuuuuauuguuaauguagcauauauaaaaaaguaucucau

SEQ ID NO: 1562 - RNA, 63 nt, Homo sapiens
ugagucaaggaguguaaccuucuccuuuacuauguugaauguauuuuuuucuggacaagcuua

SEQ ID NO: 1563 - RNA, 61 nt, Homo sapiens
ugagugaccguuugaauccauauguagucccauuggugcuaaugagaguagcugcugugaa

SEQ ID NO: 1564 - RNA, 63 nt, Homo sapiens
ugagugaguccuuuuuuuaugguguccucccucugugaauguacaggcggaacuguacgaaca

SEQ ID NO: 1565 - RNA, 63 nt, Homo sapiens
ugagugcaacuaugugccaugcacuccaaaguagguccccacaguuauucucucauagccuug

SEQ ID NO: 1566 - RNA, 62 nt, Homo sapiens
ugagugcccgauuccucuuagagaaaauccauagcuacuguagguucugucuugggccacuu

SEQ ID NO: 1567 - RNA, 62 nt, Homo sapiens
ugaguucccgcaggugacauacggacuggccucucuacuguacugggugccaucucccacca

SEQ ID NO: 1568 - RNA, 63 nt, Homo sapiens
ugaguuucugacaaauuuguuuuaaaaaucaaauuugaauguacuauucuauaaauugccuuu

SEQ ID NO: 1569 - RNA, 62 nt, Homo sapiens
ugauaauuauuuagaugugaauguuaggucaguucuacuguaauaacuaaucguaaaaguug

SEQ ID NO: 1570 - RNA, 62 nt, Homo sapiens
ugauaguauugguagggcugaauauggauggcaucuacuguaaaacaagucuaccuugucag

SEQ ID NO: 1571 - RNA, 63 nt, Homo sapiens
ugauaucuguaccccugauccaaguaaggccuuuaugaauguauuuuauauuuccuaaagaaa

SEQ ID NO: 1572 - RNA, 62 nt, Homo sapiens
ugauauuaagaucaaagggaggaagggaagacagcaguauuaauucacccuagauuacucaa

SEQ ID NO: 1573 - RNA, 64 nt, Homo sapiens
ugaucauuaauaugcaaugguagaucagauugggggauguagcaaacuggacuuuaagaacugg

SEQ ID NO: 1574 - RNA, 64 nt, Homo sapiens
ugaucccugcuuggaguuuuaguuuaaagaaucuauauguagcaaggaaaaggugcuuuuuaau

SEQ ID NO: 1575 - RNA, 62 nt, Homo sapiens
ugauccuuuguauuguggaugcacacagcuuuaccuacuguacugguagucuucacuucuau

SEQ ID NO: 1576 - RNA, 63 nt, Homo sapiens
ugaugaacuuuggaguacuguuucuuccuucaaacugaauguaauuaauucaugaauaaaugc

SEQ ID NO: 1577 - RNA, 63 nt, Homo sapiens
ugaugcacuuugaauauugagauauuuugcacggaugaauguaugggaacuacccaugaugau

SEQ ID NO: 1578 - RNA, 63 nt, Homo sapiens
ugauggguuuguugguauuuaaaaugaauacaacuugaauguaauuaaagugcuguuuuuugg

SEQ ID NO: 1579 - RNA, 63 nt, Homo sapiens
ugauuuccuucaguuaucuuccaaauguuguuuuuuccccacagcccccuuaacauuguucuc

SEQ ID NO: 1580 - RNA, 62 nt, Homo sapiens
ugcaaaaaagaaacaauaaagaaagaaauauuaacuacuguagaacugauuuuacaaauuaa

SEQ ID NO: 1581 - RNA, 62 nt, Homo sapiens
ugcaaaaauauuuauaaaacuucucaagauacugcuacuguaauuuuauaugaagauaagug

SEQ ID NO: 1582 - RNA, 62 nt, Homo sapiens
ugcaaauuauggccauauggcugauuggaauguacuacuguaauauaaaaagucacuguauu

SEQ ID NO: 1583 - RNA, 63 nt, Homo sapiens
ugcaacuguggcuuagcuaauauugcaauguggcuugaauguagguagcauccuuugaugcuu

SEQ ID NO: 1584 - RNA, 63 nt, Homo sapiens
ugcaaggauagcacaguacugagccaaccauagacuccccacaaggaguugcuguuguuauua

SEQ ID NO: 1585 - RNA, 63 nt, Homo sapiens
ugcaaugacucaggacauccccccgccaaaagcugcucagggaaaagcagcucuccccucaga

SEQ ID NO: 1586 - RNA, 63 nt, Homo sapiens
ugcacaaacucaugccauacccuaagggacaagguuccccacaucuacuuggaaaucuuuggg

SEQ ID NO: 1587 - RNA, 63 nt, Homo sapiens
ugcacacaccacagaaugugugagauuuuccuguuugaauguaugucugcauuauacuccugc

SEQ ID NO: 1588 - RNA, 61 nt, Homo sapiens
ugcacaucgcgcccucgggcccugccaugucccuggugcuacugaccucucaaggcuuccu

SEQ ID NO: 1589 - RNA, 63 nt, Homo sapiens
ugcaccguggagucauuccaagacuccuguccucacucagggauucuucauuucuucuuccua

SEQ ID NO: 1590 - RNA, 63 nt, Homo sapiens
ugcacggggauggggggacaacuccuacccuucuuuccccacaugccccacuaaaccaucuga

SEQ ID NO: 1591 - RNA, 63 nt, Homo sapiens
ugcacuagccauagcuggugacaaacagaugguugcucagggacaaggugccuuccaauggaa

SEQ ID NO: 1592 - RNA, 63 nt, Homo sapiens
ugcacugguagaugccguuucuucccuuccccuucuccccacaccugcacugggucuggauca

SEQ ID NO: 1593 - RNA, 61 nt, Homo sapiens
ugcacugucuagacaggaaaccuaggaagauguuggugcuaaacugaaaagauuucuuaca

SEQ ID NO: 1594 - RNA, 62 nt, Homo sapiens
ugcacuuaaugccgauuaaugccagaauugaauuguaugauauccaguugguauuggagaau

SEQ ID NO: 1595 - RNA, 62 nt, Homo sapiens
ugcagaucccagagucaguaaaucugccugugaaguaugauagucugcauuuguaaugagca

SEQ ID NO: 1596 - RNA, 61 nt, Homo sapiens
ugcagcugagggauuuucacagugugcuccagauggugcuagaggaagucccagagccugu

SEQ ID NO: 1597 - RNA, 64 nt, Homo sapiens
ugcagucaaggaguaccacuguauugauuagccuguauguagcagggcucccuucauugcaucu

SEQ ID NO: 1598 - RNA, 63 nt, Homo sapiens
ugcagugagcaucacuacagucucagucaacagugugaauguaucauguuuuacuuuaaaugu

SEQ ID NO: 1599 - RNA, 62 nt, Homo sapiens
ugcaucagcugcuuugaaggcugaagauuguuuuguaugauacugcacagcaucaggcauuu

SEQ ID NO: 1600 - RNA, 63 nt, Homo sapiens
ugcaucggggaagggugagaaggagagccugccugcucagggauccaggcucguagagucacu

SEQ ID NO: 1601 - RNA, 63 nt, Homo sapiens
ugcaugaaaaguacagcgugaaagcaacccuuucuuccccacacccagagaggugaggcccgc

SEQ ID NO: 1602 - RNA, 63 nt, Homo sapiens
ugcaugcugccaguuccuguucuguguucaccacauccccacaccccauugccacuuauuuau

SEQ ID NO: 1603 - RNA, 63 nt, Homo sapiens
ugcauggagugaccauagcuccuucucucuuacauugaauguagagaauguagccauuguagc

SEQ ID NO: 1604 - RNA, 63 nt, Homo sapiens
ugcauuugacacaauauuguaauaauccaugauuuugaauguaaaguauauaugaugucauua

SEQ ID NO: 1605 - RNA, 62 nt, Homo sapiens
ugcauuugcuuggcuccuaguaacaauucuuuuacaguauuagcacucucuuuacuaaggaa

SEQ ID NO: 1606 - RNA, 63 nt, Homo sapiens
ugccaacaaggacuggggccugcccggcugcccgccucagggaugggcaccucaugccugucu

SEQ ID NO: 1607 - RNA, 63 nt, Homo sapiens
ugccaacugaggcccgcggcucccuccgacccugcuccccacagagccucaguaaacccaugc

SEQ ID NO: 1608 - RNA, 64 nt, Homo sapiens
ugccaccugggccuugaauuccugggcugugaagacauguagcagcugcaggguuuaccacacg

SEQ ID NO: 1609 - RNA, 61 nt, Homo sapiens
ugccaggggcccugccucccaauauuaucaccuuggugcuaaccaauauuuucuaacuucc

SEQ ID NO: 1610 - RNA, 63 nt, Homo sapiens
ugcccaagagaaagacuagaaggacuaaaagcaguugaauguaugguacugacauugucauaa

SEQ ID NO: 1611 - RNA, 63 nt, Homo sapiens
ugcccacaagccuggcagcuguagagccgcgaaccuccccacaccucccucaccgcgcaggac

SEQ ID NO: 1612 - RNA, 63 nt, Homo sapiens
ugcccagagaacguaaccuccugcucccuguggcacucagggagcauuuaauggcagcuagug

SEQ ID NO: 1613 - RNA, 63 nt, Homo sapiens
ugccccuuugcccgccuccugcaaaccucacaggguccccacacaacagugcccuccagaagc

SEQ ID NO: 1614 - RNA, 63 nt, Homo sapiens
ugcccucucccagucccccuguggcuucugaaaaucucagggacagaugaggcugagccccua

SEQ ID NO: 1615 - RNA, 63 nt, Homo sapiens
ugcccuugaggagcacaggcagaagugugaacuugugaauguaauugaucuuuccuuccuucc

SEQ ID NO: 1616 - RNA, 63 nt, Homo sapiens
ugccgcauagugcauaggcugaaaugucucaagauuccccacacuacauaucaguauuuucua

SEQ ID NO: 1617 - RNA, 58 nt, Homo sapiens
ugccuacuggaccaugugaggccuggcacuuccccacaaccagcacaggcuuccacuu

SEQ ID NO: 1618 - RNA, 63 nt, Homo sapiens
ugccuguucuaaaugaacuuuacauauauuuuaaaugaauguauguacuuacguauaaauguc

SEQ ID NO: 1619 - RNA, 62 nt, Homo sapiens
ugccuugagggcaggggcaguggcuggauggugccuacuguaggccuggagcucucuucugg

SEQ ID NO: 1620 - RNA, 63 nt, Homo sapiens
ugccuuuuaagaacugggcagaggccacagucaccuccccacacagagcuguccccacugccc

SEQ ID NO: 1621 - RNA, 62 nt, Homo sapiens
aguuugaguuaggagcuuuuaccuuguagcagagcaguauuaacaccuaguugguucaccug

SEQ ID NO: 1622 - RNA, 64 nt, Homo sapiens
aguuugugaaagguguggugggugaaacuaagagaaauguagcauuagcucucacaaaagagga

SEQ ID NO: 1623 - RNA, 61 nt, Homo sapiens
aguuuugcucucauugcccaggcuggagugcgguggugcuauuucagcucaccacaaccuc

SEQ ID NO: 1624 - RNA, 64 nt, Homo sapiens
auaaaaacuggcgauuuccuccauacucaaggcaucauguagcagggagugccuuggguguugu

SEQ ID NO: 1625 - RNA, 62 nt, Homo sapiens
auaaaaauuacacuuuuuuuuuugguuuauuccccaguauuaaaaacaaagcaagcugaguc

SEQ ID NO: 1626 - RNA, 63 nt, Homo sapiens
auaaaacuuugauaucaugccaguaagcuagauguugaauguauguaaguagcauuugguaac

SEQ ID NO: 1627 - RNA, 64 nt, Homo sapiens
auaaacaguuuucuuuuguauccugacuuacuuucuauguagcaucuggugucaugaauuguga

SEQ ID NO: 1628 - RNA, 63 nt, Homo sapiens
auaaacuauaucuuggcuaguggcuacugugucugugaauguaaccaguacuucuuuaagcuc

SEQ ID NO: 1629 - RNA, 64 nt, Homo sapiens
auaaacuuuucaaaauuuauguaauguggggcuuuuauguagcacuuuacguuuucaugcugcu

SEQ ID NO: 1630 - RNA, 63 nt, Homo sapiens
auaaagguaaaaaaaauuccccaaauauuuugcacugaauguaccaaaggugaagggacauua

SEQ ID NO: 1631 - RNA, 63 nt, Homo sapiens
auaaaguaaaauaaugggcauuaucauuggauguuuccccacauuggcuuuuaaaauacccau

SEQ ID NO: 1632 - RNA, 62 nt, Homo sapiens
auaaauagauuuugguagcaaguguaaucacuccguaugauauaauaaauuucuaaaagauu

SEQ ID NO: 1633 - RNA, 63 nt, Homo sapiens
auaaauuuguauuuauguguauauaaaauguacaaugaauguaaauaugacuuucuggaaagu

SEQ ID NO: 1634 - RNA, 62 nt, Homo sapiens
auaaauuuuauuccaaaauaacaaaauaaauaaucuacuguacacaaucugccagcuggagg

SEQ ID NO: 1635 - RNA, 61 nt, Homo sapiens
auaacaacguauguaauuguaacauugcaguaauggugcuacgaagccauuucucuugauu

SEQ ID NO: 1636 - RNA, 62 nt, Homo sapiens
auaacaagagagugaaagccaaagcacuuucugucuacuguacucuucuaaauggaauuuua

SEQ ID NO: 1637 - RNA, 62 nt, Homo sapiens
auaaccaguaugaaagucguugcgccgugaaucucuacuguagccaugaauuuauggacagu

SEQ ID NO: 1638 - RNA, 63 nt, Homo sapiens
auaaccauuucaccuggacuaucuaaucaguccuaugaauguaucccuaaaugugguuauuga

SEQ ID NO: 1639 - RNA, 63 nt, Homo sapiens
auaaccuauuguuagaaaauauguguuuuuauaaaugaauguaaaauaauuaaaugaauugug

SEQ ID NO: 1640 - RNA, 63 nt, Homo sapiens
auaacuauguaaauuguuuuugaaaauaauuuguuuccccacaacuuuugaagguuuuauuug

SEQ ID NO: 1641 - RNA, 64 nt, Homo sapiens
auaaggaauuaaucuucauauauauuaucaucccuaauguagcagggggaaguauuuaauugcc

SEQ ID NO: 1642 - RNA, 62 nt, Homo sapiens
auaauaaauuauacacuaugaaaccgccauugggcuacuguagauuuguauccuugaugaau

SEQ ID NO: 1643 - RNA, 63 nt, Homo sapiens
auaauacuacaaauuguguuuuggagcaacuucauugaauguaauuguccucaaaucagagaa

SEQ ID NO: 1644 - RNA, 63 nt, Homo sapiens
auaauacucauuuacagcuaugucuagguucuccgcucagggaaucacaaggcuagaaaucaa

SEQ ID NO: 1645 - RNA, 62 nt, Homo sapiens
auaaucaaaacaccgcguaggcuccuccguuuaucaguauuaaugguguaacuuuguuggca

SEQ ID NO: 1646 - RNA, 61 nt, Homo sapiens
auaaugguuuuuaacaccuuuuacucuucuuacuggugcuauuuuguagaauaaggaacaa

SEQ ID NO: 1647 - RNA, 63 nt, Homo sapiens
auaauuguugacuuucuuagauucacuuccauaugugaauguaagcucuuaacuaugucucuu

SEQ ID NO: 1648 - RNA, 63 nt, Homo sapiens
auaauuuauacuggagaaaaacuuugcaaguauaaugaauguagcagagccuuuaguuuuugu

SEQ ID NO: 1649 - RNA, 63 nt, Homo sapiens
auaauuuucuaguuccuuuuuaaugaugauuauucugaauguauuugccacuacauuuacaau

SEQ ID NO: 1650 - RNA, 62 nt, Homo sapiens
auacagauguacuagcuaaagucucuuuaugugucaguauuaagaguaauauguagccagau

SEQ ID NO: 1651 - RNA, 63 nt, Homo sapiens
auacauaugagaagucauacuggugagaaacccuuugaauguaaugaaugugggaaagcauuc

SEQ ID NO: 1652 - RNA, 63 nt, Homo sapiens
auacaugaaagaacccacacuggagagaaaccuuaugaauguaaacagugugguaaagccuuc

SEQ ID NO: 1653 - RNA, 63 nt, Homo sapiens
auacaugaaaggacucauacgagagagaauccguaugaauguaaggauugugggaaagcauuc

SEQ ID NO: 1654 - RNA, 63 nt, Homo sapiens
auacaugaaaggaugcacagaggagagaagcucugugaauguaagcauugugggaaagcauuc

SEQ ID NO: 1655 - RNA, 63 nt, Homo sapiens
auacaugaacgaauucauacuggagagaaacccuaugaauguaaagaauguggaaaacccuuc

SEQ ID NO: 1656 - RNA, 63 nt, Homo sapiens
auacaugcaagaacacacaauggagagaaacccuaugaauguaaagaaugcagaaaagcauuc

SEQ ID NO: 1657 - RNA, 62 nt, Homo sapiens
auaccacacccuacuacuucaccucccuuuccaacuacuguagaagauacucacuguuauca

SEQ ID NO: 1658 - RNA, 64 nt, Homo sapiens
auaccugcuguuggcuuuuggaaaaauugguacuguauguagcaaaauaaugugaaacccauau

SEQ ID NO: 1659 - RNA, 63 nt, Homo sapiens
auacuaguguguucauuauagaguaucuguagaggugaauguaaaaguaaguccaaucuauuu

SEQ ID NO: 1660 - RNA, 63 nt, Homo sapiens
auacuguuuuccagagguuguaaaauguacauuccuccccacaguguauaagcugugccuuua

SEQ ID NO: 1661 - RNA, 63 nt, Homo sapiens
auagaacauguauacagcauauauuauagcauacaugaauguaaauagguauuagaaaagaaa

SEQ ID NO: 1662 - RNA, 63 nt, Homo sapiens
auagacauguaaagacacaccagaaggaaacccuaugaauguaagcaauguggcaaaagcuuu

SEQ ID NO: 1663 - RNA, 63 nt, Homo sapiens
auaggaccaaaacagaauauuguagauggcaguuaugaauguauauuuauauuuugauuaaga

SEQ ID NO: 1664 - RNA, 63 nt, Homo sapiens
auaggcacugauuauuuugaucuguuuguaacaaaugaauguaaguacuauuuacauggugug

SEQ ID NO: 1665 - RNA, 63 nt, Homo sapiens
auaggcuucccaaagccccauucuaacuccccucucucagggaagcccuagagagagguccaa

SEQ ID NO: 1666 - RNA, 62 nt, Homo sapiens
auaggguaaaugagaaaaugggacagauuauacaguaugauaaauuuuauauacaugaagua

SEQ ID NO: 1667 - RNA, 62 nt, Homo sapiens
auagucaugauagugaguauucuuacacuguucccaguauuacagggaaugcuuagaaauuu

SEQ ID NO: 1668 - RNA, 61 nt, Homo sapiens
auagugagagaaaugggauuucaucacaauucauggugcuaaaaugaaaaccucugcacuu

SEQ ID NO: 1669 - RNA, 61 nt, Homo sapiens
auaguuuuacauuucacuggacuagauaaaaaauggugcuaauauuuauguagcuugaugc

SEQ ID NO: 1670 - RNA, 62 nt, Homo sapiens
auauaaaccauuuuuauuucaugcauuaaaaauaguaugauaaagauuucagaguacagguc

SEQ ID NO: 1671 - RNA, 64 nt, Homo sapiens
auauaaauuuuguucuugugcuaaagcugguaguuuauguagcagacaaaauauacaaauaaaa

SEQ ID NO: 1672 - RNA, 62 nt, Homo sapiens
auauaaucacuccuguccuaauucuuggugauuucaguauuacaaagaugauccucccaaca

SEQ ID NO: 1673 - RNA, 62 nt, Homo sapiens
auauaaugaacuuuguacuauucacauuuuguaucaguauuauguagcauaacaaaggucau

SEQ ID NO: 1674 - RNA, 63 nt, Homo sapiens
auauagaaaaaaacauucuaucuacugauuugggcugaauguauguaaauagguuucuaaaaa

SEQ ID NO: 1675 - RNA, 61 nt, Homo sapiens
auauagagaugacauguuuucaccccaacuaucuggugcuauugaaugacuaauucagucc

SEQ ID NO: 1676 - RNA, 63 nt, Homo sapiens
auauaugcauuccauuugggagcauagcagcugugugaauguauguaauuguguguggggggu

SEQ ID NO: 1677 - RNA, 62 nt, Homo sapiens
auauauuaaggccuuuugcuuuagugaagaugaacuacuguaauaauuauuguauuagguug

SEQ ID NO: 1678 - RNA, 63 nt, Homo sapiens
auauauuuauacacauacaauuuauguuuuccuguugaauguauuuuuaugagauuuuaacca

SEQ ID NO: 1679 - RNA, 63 nt, Homo sapiens
auaucagagauacacaaaaaaccaauugaggguagugaauguaagaagacagucccagaagua

SEQ ID NO: 1680 - RNA, 62 nt, Homo sapiens
auaucuauacuguaaauauuugguuuauuuggcacuacuguaaguuuuguuuuucacaaagc

SEQ ID NO: 1681 - RNA, 61 nt, Homo sapiens
auaucuucuauuugcauaacauaguuuuuuuguuggugcuauuaauucaaaggaaaauguu

SEQ ID NO: 1682 - RNA, 62 nt, Homo sapiens
auaugcuuugauugaugcagcauuaugcuuugggcaguauuacaaaauagcuggcgagugcu

SEQ ID NO: 1683 - RNA, 62 nt, Homo sapiens
auauuccucauuuaaaauuuuugcacugcauuuucuacuguaaaccaaaagagguuacuaag

SEQ ID NO: 1684 - RNA, 62 nt, Homo sapiens
auauuuaauccuuaaaaccccuuuaaaugagggccaguauuaucucugcuuucagaaguaga

SEQ ID NO: 1685 - RNA, 62 nt, Homo sapiens
auauuuacuugaguaaggaacacuuuugugcguacaguauuauuuggcuucuucaguugugc

SEQ ID NO: 1686 - RNA, 63 nt, Homo sapiens
auauuuuauccccauuuuacugcaaaguugacaagcucagggaaaauaaauaguuggccagaa

SEQ ID NO: 1687 - RNA, 63 nt, Homo sapiens
auauuuuuagcagaacaggacuuacagggucauuguccccacaaugugccagucgacuauuug

SEQ ID NO: 1688 - RNA, 61 nt, Homo sapiens
aucaaaaucauaguaaaauauuaccuguuuucauggugcuaauauuaccuguucucccacu

SEQ ID NO: 1689 - RNA, 64 nt, Homo sapiens
aucaaaccuuaaaauagcuacacucugcccucuguaauguagcauucauaaaaauuuggaagua

SEQ ID NO: 1690 - RNA, 63 nt, Homo sapiens
aucaacagggagacgugggagacacacaggggguccucagggaacacacaugugcucaagcuu

SEQ ID NO: 1691 - RNA, 62 nt, Homo sapiens
aucaaggauuuucauguugaugacucgaaacugacaguauuaaggguaggauguugcuucug

SEQ ID NO: 1692 - RNA, 63 nt, Homo sapiens
aucaaggccaccuccaccacaaccgaaaguaucaucucagggaaacuuaauuccugcccgucc

SEQ ID NO: 1693 - RNA, 63 nt, Homo sapiens
aucaauauuuugaagugauacacagaugucuuuccuccccacaaacuuuuuuaaacaaaaaac

SEQ ID NO: 1694 - RNA, 63 nt, Homo sapiens
aucacccucgcgcuaucuucagugacgggugacggcucagggagauggcaggcagauugggcu

SEQ ID NO: 1695 - RNA, 63 nt, Homo sapiens
aucagcacaggggucccugccccacccuccggcagcucagggaguguuuuccugugaggccuc

SEQ ID NO: 1696 - RNA, 63 nt, Homo sapiens
aucagcgacccugaggaagaugacgaguaacuccccucagggauacgacacaugcccaugaug

SEQ ID NO: 1697 - RNA, 64 nt, Homo sapiens
aucagucagcuacugcuguguaacaaaugaccacaaauguagcaaccagaaacaacacaugcuu

SEQ ID NO: 1698 - RNA, 62 nt, Homo sapiens
aucagugcuuugguacuuuugauuaccuguguuucaguauuagugucacuuuaguacuucag

SEQ ID NO: 1699 - RNA, 62 nt, Homo sapiens
aucaugaguggguauuuugauucuaugguucccucaguauuacaucuugacuuguaaucaau

SEQ ID NO: 1700 - RNA, 63 nt, Homo sapiens
aucauuauuuauuuuuuuguaguaguaaugucauaugaauguaucuuaaaacgugugcccuuu

SEQ ID NO: 1701 - RNA, 63 nt, Homo sapiens
aucauuccauagguuuaaccauacauuuuccaagacucagggaacacagugaucuacacagag

SEQ ID NO: 1702 - RNA, 62 nt, Homo sapiens
aucauuggaauauuugcauuuugcacaaugacugguaugauagcucuugacaaauaaggaaa

SEQ ID NO: 1703 - RNA, 63 nt, Homo sapiens
aucauuugcauaagauuuaacagcauuuuuuauaaugaauguaaacauuuuaacuuaauggua

SEQ ID NO: 1704 - RNA, 63 nt, Homo sapiens
aucauuuggguuugaggguguguuauuuugagucaugaauguacaagcucugugaaucagacc

SEQ ID NO: 1705 - RNA, 63 nt, Homo sapiens
aucccaagauccuggggaaaggagagaccauggugugaauguagagaugccaccucccucucu

SEQ ID NO: 1706 - RNA, 63 nt, Homo sapiens
aucccaucuuuuccuucggcagauugcagccccauuccccacaaugcauccagaaaucgcugu

SEQ ID NO: 1707 - RNA, 62 nt, Homo sapiens
aucccauuuuaucauccuuucaguuuuuauuaaucuacuguaucaauaaaauucuguaauuu

SEQ ID NO: 1708 - RNA, 63 nt, Homo sapiens
auccgacauaaaauuccugcucugccacagcuccacucagggaucaugguugggacacuugcu

SEQ ID NO: 1709 - RNA, 63 nt, Homo sapiens
auccucccagaaagcaaaccuguaagugucuugggcucagggaccauggcuuguagcccuuuc

SEQ ID NO: 1710 - RNA, 64 nt, Homo sapiens
auccucugggaucuucugagguggacagcacuuugaauguagcauuucacuggaacagagucuu

SEQ ID NO: 1711 - RNA, 63 nt, Homo sapiens
auccuucacuucucugaaaguaaggcccuagaugccucagggaagacaguaaucaugccuuuu

SEQ ID NO: 1712 - RNA, 62 nt, Homo sapiens
aucgagccauagcuauccaaaguggucugcauuucuacuguaaaaugcaauuugaaaaaaau

SEQ ID NO: 1713 - RNA, 63 nt, Homo sapiens
aucguccugcuucccaguggguucagaccucaccucucagggagcgaccugggcaaagacaga

SEQ ID NO: 1714 - RNA, 63 nt, Homo sapiens
aucgugggcacgggcagggcucagccgcucccaccuccccacagaagcccaggagugugugga

SEQ ID NO: 1715 - RNA, 62 nt, Homo sapiens
aucuaagguaaaauguguuucuguuuuguaaaaacuacuguagauuuuuacuuacaagugcc

SEQ ID NO: 1716 - RNA, 61 nt, Homo sapiens
aucuaagucuuccaaugccugcaucaaacuuucuggugcuaggaaaggaaaaaaauaauaa

SEQ ID NO: 1717 - RNA, 63 nt, Homo sapiens
aucuaauaaggagauuuaagauaagacccaauaaaugaauguauucuguuuaucagaaaaccc

SEQ ID NO: 1718 - RNA, 62 nt, Homo sapiens
aucuaccuauacuuaaucuaagaaacaaaguaaucuacuguaaaguacucugccccuugaaa

SEQ ID NO: 1719 - RNA, 61 nt, Homo sapiens
aucuacuuuuacucauaaguaaaagcccuagacuggugcuaaugucaaaccacuggccucc

SEQ ID NO: 1720 - RNA, 63 nt, Homo sapiens
aucucagggaccaugaugucucagucacuccacgcuccccacaggccaacccuggcacagguc

SEQ ID NO: 1721 - RNA, 63 nt, Homo sapiens
aucucaucguaaggcagcuaguucuaauuugcauuugaauguauaacaaauugcaucacuuuu

SEQ ID NO: 1722 - RNA, 63 nt, Homo sapiens
aucucauuucuuccuuugcuggcagccuccacccuuccccacaucagucggccuaauccaaac

SEQ ID NO: 1723 - RNA, 63 nt, Homo sapiens
aucugaaauauaugccgaaaauugacgucuuugaccucagggagagcaccuguccaggucugc

SEQ ID NO: 1724 - RNA, 63 nt, Homo sapiens
aucugaacuauaucuugacaaauauuauucaaacuugaauguaaauauauacaguauguauau

SEQ ID NO: 1725 - RNA, 62 nt, Homo sapiens
aucuggguugccauggcaauggcaugccccccagcuacuguaugcccccgacccccgcagag

SEQ ID NO: 1726 - RNA, 63 nt, Homo sapiens
aucugucauuauugcccugaucacaaacaaaagccugaauguacuauguuuaaaagacaaacc

SEQ ID NO: 1727 - RNA, 64 nt, Homo sapiens
aucugugcuaagcuuuacaguggcaaaaauaaugacauguagcaaagauuuucaaacaaaauau

SEQ ID NO: 1728 - RNA, 63 nt, Homo sapiens
aucuucaccccacuuccucuacccccagguucuccuccccacagccaguccccuuuccuggau

SEQ ID NO: 1729 - RNA, 63 nt, Homo sapiens
aucuuccuugggccuuuggaaaaauaugugacaagugaauguaagucugugccuggagagcua

SEQ ID NO: 1730 - RNA, 62 nt, Homo sapiens
aucuugacucuucauuuguuucagaauagcucuucuacuguauucugacaacucuuugcuuu

SEQ ID NO: 1731 - RNA, 63 nt, Homo sapiens
aucuuuccaaaauccucacucuguucauuguuugucucagggaaaaucuucccccaccgagcu

SEQ ID NO: 1732 - RNA, 62 nt, Homo sapiens
aucuuuguugagagauuugagguagcuccuguugcaguauuaauuuauaauauuuuaaaagu

SEQ ID NO: 1733 - RNA, 62 nt, Homo sapiens
augaaaguuaaagaauguacugugaugaaauguucaguauuauguugcuucucaguaucaug

SEQ ID NO: 1734 - RNA, 61 nt, Homo sapiens
augaaaucuucuugauuuuaaauaauauacgaauggugcuauuaauauugcuaaaaucaac

SEQ ID NO: 1735 - RNA, 61 nt, Homo sapiens
augaaaugcucuuuacauucaauuuucuguguguggugcuaauuuccauugugacuuugga

SEQ ID NO: 1736 - RNA, 64 nt, Homo sapiens
augaacuuuguacuauucacauuuuguaucaguauuauguagcauaacaaaggucauaaugcuu

SEQ ID NO: 1737 - RNA, 62 nt, Homo sapiens
augaaggaacugcucaucuaagcaaaagauuugaguaugauaugauaaaggcuuucuacauu

SEQ ID NO: 1738 - RNA, 62 nt, Homo sapiens
augaaguagguuccaguacuaaugaagugggcuccaguauuaaugaaauagguuccagugau

SEQ ID NO: 1739 - RNA, 62 nt, Homo sapiens
augaauauuuuuuguacuugguuuacuuggguugguaugauacauuauauuuaaguuccuug

SEQ ID NO: 1740 - RNA, 62 nt, Homo sapiens
augaauuuaaaagucaacccuucacacaguuucccuacuguauguagaauccaggugcugaa

SEQ ID NO: 1741 - RNA, 61 nt, Homo sapiens
augacacgcugcccgugccccuagcaggagcccuggugcuacccccugugaagagccaagc

SEQ ID NO: 1742 - RNA, 62 nt, Homo sapiens
augagagugaaagggacaaauaacaucuguguagcaguauuaugaaaauagcuugaccucgu

SEQ ID NO: 1743 - RNA, 62 nt, Homo sapiens
augagcucauugcacuuaauaccugcaauguuugcuacuguaccacaauugauuuucaauac

SEQ ID NO: 1744 - RNA, 61 nt, Homo sapiens
augagguuuucauuuuuauucuuccuuccaacguggugcuaucucugaaacgagcguuaga

SEQ ID NO: 1745 - RNA, 62 nt, Homo sapiens
augagucucugcagguguacaaaaaaaccccaaucuacuguaaauggcaguuuaauuguuag

SEQ ID NO: 1746 - RNA, 63 nt, Homo sapiens
augauacuaguaauucauaagggaucuguguaaucugaauguauuugaauaacuuuagcucua

SEQ ID NO: 1747 - RNA, 62 nt, Homo sapiens
augauaggggaucaguaaauuguaauuccuaacccuacuguacucccaaacauggugauuca

SEQ ID NO: 1748 - RNA, 64 nt, Homo sapiens
augaugagguaauaaucaaauuuaagaauuugugacauguagcaauucaagaaacaaaaaggua

SEQ ID NO: 1749 - RNA, 63 nt, Homo sapiens
augaugauaaagaauuuggagccaauuuugauauaugaauguauugcuuuuacaugugaugau

SEQ ID NO: 1750 - RNA, 61 nt, Homo sapiens
augauggcuuggaaaagcaggcuagucuaaccauggugcuauuauuaggcuugcuuguuac

SEQ ID NO: 1751 - RNA, 62 nt, Homo sapiens
augauucgugaauaaaacuagguacauaguaaguguaugauagauguuugauuuguaaauua

SEQ ID NO: 1752 - RNA, 62 nt, Homo sapiens
augcacgccuuguuuucccacuagugucaguaucguaugauaagaaacugaaaucuauaaau

SEQ ID NO: 1753 - RNA, 62 nt, Homo sapiens
augcauaaauggaggucaauuugauuguccugaccuacuguauaaguaaauuucaaauguca

SEQ ID NO: 1754 - RNA, 63 nt, Homo sapiens
augcaugaaagaauucacacuggggagaaauacuaugaauguaaggauaugaguguuguuacc

SEQ ID NO: 1755 - RNA, 63 nt, Homo sapiens
augcauggaagcacucacacuuggcagaaacucuaugaauguaagcaguaugggaaagccuuc

SEQ ID NO: 1756 - RNA, 63 nt, Homo sapiens
augcauggaaggacucacacuggagaaaaacccuaugaauguaagcaguaugggaaagcguuc

SEQ ID NO: 1757 - RNA, 64 nt, Homo sapiens
augccuauuguuggauacugaaugacagacaaucuuauguagcaaagauuaugccugaaaagga

SEQ ID NO: 1758 - RNA, 63 nt, Homo sapiens
augccuggggcaaggccaggggaaacugggggggccucagggacaggccuggaaaggccacga

SEQ ID NO: 1759 - RNA, 63 nt, Homo sapiens
augcgugggggcacuacuaagaaugcuaaacuuaguccccacaacaaagaaucauccuguccc

SEQ ID NO: 1760 - RNA, 64 nt, Homo sapiens
augcguuugauuguuugagauuuucuguuuuuaaaaauguagcacuugacuuuuugccaaggaa

SEQ ID NO: 1761 - RNA, 62 nt, Homo sapiens
augcuaaguggaaacugcaugaauuaaaagagggguaugauagggacauuguccuuugggcu

SEQ ID NO: 1762 - RNA, 64 nt, Homo sapiens
augcuuuuaaaaaauguuccauauuuaucuuugaacauguagcaucucuuuccgcaaauaaaug

SEQ ID NO: 1763 - RNA, 63 nt, Homo sapiens
auggaagaggagugagggcagccucacugugugcccucagggauacgagauucucuguuggaa

SEQ ID NO: 1764 - RNA, 62 nt, Homo sapiens
auggaagucauaaauggacauuauagucucuaaacaguauuaaacccuuaaccacuucuaaa

SEQ ID NO: 1765 - RNA, 62 nt, Homo sapiens
auggacagguucuguuuucacuuuuucguaugcacuacuguauuuccuuucuaaauaaaauu

SEQ ID NO: 1766 - RNA, 63 nt, Homo sapiens
auggagacagaaaguagaauagugguugccaaugucucagggagguugaaauaggagaugacc

SEQ ID NO: 1767 - RNA, 63 nt, Homo sapiens
auggagcuugcuccgggggaccgggacugucuguucucagggaccaucucggcugccuccugu

SEQ ID NO: 1768 - RNA, 62 nt, Homo sapiens
auggcaaaacuaugcuuuugccaccuuccuguugcaguauuacuuugcuuuuaucuuuucuu

SEQ ID NO: 1769 - RNA, 63 nt, Homo sapiens
auggccuaagaaauaaggaucaauaaggaaugauuugaauguaauuuugugaauguguggaaa

SEQ ID NO: 1770 - RNA, 62 nt, Homo sapiens
augggacaaagcauuauggucuuuuuggguaagacaguauuagcaggauuuguaaaggguuu

SEQ ID NO: 1771 - RNA, 64 nt, Homo sapiens
augggcacuuaaagcuuucagaauaugucagugcugauguagcaugcuuguugcaauugccuuu

SEQ ID NO: 1772 - RNA, 63 nt, Homo sapiens
auggggaaggagcagucucccagcccugggucugcuccccacaucucuccuaauuccacuuca

SEQ ID NO: 1773 - RNA, 63 nt, Homo sapiens
auggggggacaacuccuacccuucuuuccccacaugccccacuaaaccaucugacaacauuaa

SEQ ID NO: 1774 - RNA, 63 nt, Homo sapiens
augggucuuugugggggaaggcccuggcuuuguauuccccacaaguagcacugaguuucuuag

SEQ ID NO: 1775 - RNA, 62 nt, Homo sapiens
augguuauuuuacagcauacaagcuucugcuccaguaugauaauuuuuaauugccuaagaau

SEQ ID NO: 1776 - RNA, 62 nt, Homo sapiens
auguaauguaguucuuuguuccugcuuucucuuucaguauuaaacucuccuuugauauuaug

SEQ ID NO: 1777 - RNA, 63 nt, Homo sapiens
auguagauggguacaaagacaccauaaggaaauucugaauguaauacaaaggcuuauuuuucc

SEQ ID NO: 1778 - RNA, 63 nt, Homo sapiens
augucagcucaccagucucuucccugacagggcagcucagggaacuucugagaaguuaucugc

SEQ ID NO: 1779 - RNA, 63 nt, Homo sapiens
augucuaaacuauaagcuuccaacuauuaccugcuugaauguaaauauuaaauggagauguug

SEQ ID NO: 1780 - RNA, 63 nt, Homo sapiens
augugcaccagguugguguucaccagcucaugucuuccccacaucucuucuugccaguaagca

SEQ ID NO: 1781 - RNA, 63 nt, Homo sapiens
augugcggcccaagacaauucuucuuccaauguggcucagggaagccaaaagauuggacaucc

SEQ ID NO: 1782 - RNA, 63 nt, Homo sapiens
auguguacaguggcuccuugggaacugagacauaucucagggaauggugucugugcucagccc

SEQ ID NO: 1783 - RNA, 63 nt, Homo sapiens
auguguauuuguuuaccccuuuuccuucauuuauuugaauguauucuuauauucucuuggcaa

SEQ ID NO: 1784 - RNA, 62 nt, Homo sapiens
auguguccauaauuuaaaauucauguuauaguuucaguauuaaggcugacuuuuuuuuuuua

SEQ ID NO: 1785 - RNA, 63 nt, Homo sapiens
auguuccacaucaucacuccagcuccuucucuuuucucagggacaaaugaggcccagagagaa

SEQ ID NO: 1786 - RNA, 62 nt, Homo sapiens
auguugguguuuuuccuguaaagaucaguuugggguaugauauaagcagguauuaauaaaaa

SEQ ID NO: 1787 - RNA, 61 nt, Homo sapiens
auguugugugugcuggggagggguccuucuguuuggugcuacccuugucuacucugccccu

SEQ ID NO: 1788 - RNA, 62 nt, Homo sapiens
auguuuaagauacauauuuucccuguuugcuuugcuacuguauguugacuuuaagaucuuuu

SEQ ID NO: 1789 - RNA, 63 nt, Homo sapiens
auguuuucauauuuuucaaaauagguuuuuauuguugaauguacaucuaccccagccccucaa

SEQ ID NO: 1790 - RNA, 62 nt, Homo sapiens
auuaaaaccaauauuuauaaaaaguguauaugcaguaugauaccacuuuuaaaaaaagauaa

SEQ ID NO: 1791 - RNA, 62 nt, Homo sapiens
auuaaaauugccuuuuuuuugugcuguacaaugucuacuguacugugggucauuuagaugag

SEQ ID NO: 1792 - RNA, 63 nt, Homo sapiens
auuaaacauuuuaaaugcacguuuaaaaaacguguugaauguaaccccccuauuuuugugugc

SEQ ID NO: 1793 - RNA, 62 nt, Homo sapiens
auuaaaguguagcaauagcaacaaaauauuuauucuacuguaaaugacaaaagaaaaagaaa

SEQ ID NO: 1794 - RNA, 63 nt, Homo sapiens
auuaagaccugggcuagaucaccucuaacaucucacucagggaaggcaauguguugccauaaa

SEQ ID NO: 1795 - RNA, 63 nt, Homo sapiens
auuaaggaaauuuguaccauuucaguaaaccugucugaauguaccuguauacguuucaaaaac

SEQ ID NO: 1796 - RNA, 64 nt, Homo sapiens
auuaaggcaucuggguggguuuuaaacagaaugccuauguagcagugauagacauauuccccuc

SEQ ID NO: 1797 - RNA, 64 nt, Homo sapiens
auuacauguuucauauuuaaaucauguuuuccuaaaauguagcaacuacaugugauaaaagcaa

SEQ ID NO: 1798 - RNA, 62 nt, Homo sapiens
auuagaagauauuuguuuuuuaaaauauauugauguaugauaaagaugaucuaauuugugaa

SEQ ID NO: 1799 - RNA, 62 nt, Homo sapiens
auuagagauccagcacauucucaguacuguggugcaguauuagcccaaaucuguguaauggg

SEQ ID NO: 1800 - RNA, 62 nt, Homo sapiens
auuagauaugccauucauaucaaguaauguucaaguaugauaaaauuauuuugguugcuuua

SEQ ID NO: 1801 - RNA, 62 nt, Homo sapiens
auuaggaaaauuaauuuguuaacucgucugugcacaguauuauuuacucugucuguaguucc

SEQ ID NO: 1802 - RNA, 62 nt, Homo sapiens
auuaggaagccauaaaacaagauauuaugaaacccaguauuauaaauguuaucuacaucuaa

SEQ ID NO: 1803 - RNA, 62 nt, Homo sapiens
auuaggaccuauuauuuaccuguagguaagcaagcuacuguagcucuucugagguaucugcc

SEQ ID NO: 1804 - RNA, 63 nt, Homo sapiens
auuagggccgucagaaucggugcuggaagacgaaguccccacagugcaauaaugagguuccca

SEQ ID NO: 1805 - RNA, 63 nt, Homo sapiens
auuauacuauaauucauaugaaaucuugauauuaguccccacacggaaaaagugaacugcagu

SEQ ID NO: 1806 - RNA, 62 nt, Homo sapiens
auuauaucuuauauuaauuuugcaguuuugaguaguaugauaaaagaaauaagaauucaaac

SEQ ID NO: 1807 - RNA, 62 nt, Homo sapiens
auuauaucuuuaauauauaguaauguaacauauucaguauuaauguauaaaaagcacucuaa

SEQ ID NO: 1808 - RNA, 63 nt, Homo sapiens
auuauccugugaaaauauuuugaaccuaaaaagcacucagggaaaugcaaauugaaaugcuca

SEQ ID NO: 1809 - RNA, 63 nt, Homo sapiens
auuaucuuuuuguggugugaauaaaucuuuuaucuugaauguaauaagaauuuggugguguca

SEQ ID NO: 1810 - RNA, 62 nt, Homo sapiens
auuaugacuaaucugcuuuaggaguugggguaaccaguauuacaggagggacuuucagagcc

SEQ ID NO: 1811 - RNA, 63 nt, Homo sapiens
auuauggaauguuuaccagaacauguuuugauucuugaauguacauaauaaugccaucuaacu

SEQ ID NO: 1812 - RNA, 62 nt, Homo sapiens
auuaugucagugugauuauaaaaaauaaaagaucguaugauaugagauacauacuaugaaau

SEQ ID NO: 1813 - RNA, 61 nt, Homo sapiens
auuauuacuguguucgcacaguucucacuuaacuggugcuaugugaagacucugcuaauau

SEQ ID NO: 1814 - RNA, 62 nt, Homo sapiens
auuauuuugcauuaaacucuuuuuaucgggaauaguaugauauuuucagugucacuccauuc

SEQ ID NO: 1815 - RNA, 62 nt, Homo sapiens
auucaccaauuuguacauuauuuguuguccuuuacuacuguaaacaguaaauauaguuuggu

SEQ ID NO: 1816 - RNA, 63 nt, Homo sapiens
auucacgcuuaaacaaccaaccgguaaccaccacuuccccacaccgccgcccgguaauuauuu

SEQ ID NO: 1817 - RNA, 63 nt, Homo sapiens
auucagcugugaucucacaagugugaaaaaucuuaugaauguaaaauguguggagauucuucu

SEQ ID NO: 1818 - RNA, 62 nt, Homo sapiens
auucauuuauuucuguuuuguuuaccgacauauucaguauuauucuuguuuucugaauucug

SEQ ID NO: 1819 - RNA, 63 nt, Homo sapiens
auucauuuguaaaacuuuguauuaguguaacauacuccccacagucuacuuuuacaaacgccu

SEQ ID NO: 1820 - RNA, 63 nt, Homo sapiens
auuccaggcuauauauuucuuuuuaaugggccaccuccccacaacagaauucugcccaacaca

SEQ ID NO: 1821 - RNA, 63 nt, Homo sapiens
auuccaugacuucccaccgcgcccucgcuccuaccuccccacaccucucucugaguccccagg

SEQ ID NO: 1822 - RNA, 61 nt, Homo sapiens
auucccuugcgccuuuucaaagaacaguuaacuuggugcuaaugugcccuggugaaauaaa

SEQ ID NO: 1823 - RNA, 63 nt, Homo sapiens
auuccuucagggcauaagccaaaaugacucuuuuucucagggaccugcaugggccuccagcuu

SEQ ID NO: 1824 - RNA, 63 nt, Homo sapiens
auucuaaaaccucuuuguuuaguuaguacuguucaugaauguaacaagcuucaauuucucauu

SEQ ID NO: 1825 - RNA, 63 nt, Homo sapiens
auucuaaauagcgauuauaaucuccaacuuuauuuugaauguaccucuauuaguuucaauuga

SEQ ID NO: 1826 - RNA, 63 nt, Homo sapiens
auucuacccucuuuuuccugcuaauccugucauaaugaauguagcuucucaguucacuguaua

SEQ ID NO: 1827 - RNA, 63 nt, Homo sapiens
auucuagagucaucccagagauggccuagaagacuugaauguaccccaaaggauucugaaucc

SEQ ID NO: 1828 - RNA, 62 nt, Homo sapiens
auucuauaauuggcagcaucuuagaucugaggaaguaugauacuuguuugacggaaugguug

SEQ ID NO: 1829 - RNA, 62 nt, Homo sapiens
auucuaugccugcucuagaauugaaagacuucagcaguauuaaagcauuuuuuaaucuugga

SEQ ID NO: 1830 - RNA, 63 nt, Homo sapiens
auucugaaccacuagaguuuccuugauucagacuuugaauguacuguucuauaguuuuucagg

SEQ ID NO: 1831 - RNA, 63 nt, Homo sapiens
auucugaauagaugaaagcauaaaaugugagaaacugaauguauuauucaggaagaauacuga

SEQ ID NO: 1832 - RNA, 63 nt, Homo sapiens
auucugagcaccaggggcagaggcggccagacaaccucagggaggaguguccuggcgucccca

SEQ ID NO: 1833 - RNA, 63 nt, Homo sapiens
auucugcccuuguaaucggugucccuguaaaacaauccccacagauuacuuucagaaauagau

SEQ ID NO: 1834 - RNA, 62 nt, Homo sapiens
auucuuauaauuugcaccuauauaaacaaagcuccuacuguauucuucucuucaucaaccuu

SEQ ID NO: 1835 - RNA, 63 nt, Homo sapiens
auucuugguucuuugagcucguuucagaggcugaguccccacaucagcuuuaguucuuggacu

SEQ ID NO: 1836 - RNA, 61 nt, Homo sapiens
auucuugucuuugaguguuggagcccuggauucuggugcuauagcuccuggugccaaaguc

SEQ ID NO: 1837 - RNA, 64 nt, Homo sapiens
auugagaagcuauccaucucauuucugguauaguucauguagcauuguaaucgguuguucuuug

SEQ ID NO: 1838 - RNA, 63 nt, Homo sapiens
auugagauuccuaucugcccuuguauuuuuauaacugaauguaaauaggaauugcuuaaauac

SEQ ID NO: 1839 - RNA, 62 nt, Homo sapiens
auugcaacauuuccaucagacagcauuucaauuccaguauuauguauauugcaaauuaaaca

SEQ ID NO: 1840 - RNA, 63 nt, Homo sapiens
auugcaguguuguuacuaaaucuggaagugaccugugaauguauggaauacaauaaagucuuu

SEQ ID NO: 1841 - RNA, 62 nt, Homo sapiens
auugcccaacagaaaccuuaggcugaauuuacagguaugauaauuuuuguaauuaauuuucu

SEQ ID NO: 1842 - RNA, 63 nt, Homo sapiens
auugcccuauggugggcagaugaauuccagaaacccucagggagccaggauaauuaggcaacc

SEQ ID NO: 1843 - RNA, 63 nt, Homo sapiens
auugcuagugauuauugcuuguagucccacccccuuccccacauuagccuuaguauucuauau

SEQ ID NO: 1844 - RNA, 63 nt, Homo sapiens
auuggaauggguggcgguaauuggugauacuucuuugaauguagauuuccaaucacaucuuua

SEQ ID NO: 1845 - RNA, 61 nt, Homo sapiens
auuggcaguggaguaccauggaggucacugcaauggugcuaaggcugacaguggaaucuuc

SEQ ID NO: 1846 - RNA, 63 nt, Homo sapiens
auugguaauucaguguccuaugaagugggcacagcuccccacagagagcaaguugucagcagg

SEQ ID NO: 1847 - RNA, 64 nt, Homo sapiens
auuggucuuucuuagaauggucuaguuaaguuccacauguagcauaauucuuaaauaggcacuu

SEQ ID NO: 1848 - RNA, 62 nt, Homo sapiens
auuguaaauuuaaaucgccacacauggcuaguggcuacuguauuggagugcacagcucuaga

SEQ ID NO: 1849 - RNA, 62 nt, Homo sapiens
auugucaaguguucaaaucacaggugguuaguggcuacuguacugggcaacauacauuauag

SEQ ID NO: 1850 - RNA, 61 nt, Homo sapiens
auugucuauguaacauguagcgcacaccucucuuggugcuauuucauuccugcuguaagag

SEQ ID NO: 1851 - RNA, 62 nt, Homo sapiens
auugugaucccacaagacaugcaucuccacaaggcuacuguauuagaacgugcaaugcauuu

SEQ ID NO: 1852 - RNA, 64 nt, Homo sapiens
auuguuaaaacauuggcauuugaagaggagaacaaaauguagcaugauguauuuaaaguaaggc

SEQ ID NO: 1853 - RNA, 63 nt, Homo sapiens
auuguuaaacauuuagacaaacauauauguauguaugaauguacauaaauauuuuuaacuccu

SEQ ID NO: 1854 - RNA, 62 nt, Homo sapiens
auuuaaaauuucguuguccaauuuguaaguaacacaguauuaugccugaguuauaaauauuu

SEQ ID NO: 1855 - RNA, 63 nt, Homo sapiens
auuuaaacuaaaacuaguauaauuuagucuuuucaugaauguacauacauaaaauuauacaua

SEQ ID NO: 1856 - RNA, 63 nt, Homo sapiens
auuuaagaaaaucuucaucuauuucauaucuauaaugaauguagaacaucuugcuucugcuca

SEQ ID NO: 1857 - RNA, 63 nt, Homo sapiens
auuuaagacacuuuuuggacucaacguuacauuuuugaauguaguaaguaaauuaaccaaaaa

SEQ ID NO: 1858 - RNA, 63 nt, Homo sapiens
auuuaagguccaaguagaagcuugcauccuugaggcucagggaugagagggcaccgcaaggca

SEQ ID NO: 1859 - RNA, 61 nt, Homo sapiens
auuuaaucugugaggaacuaaaugacaggagauuggugcuaauacgggggaccaagcuuug

SEQ ID NO: 1860 - RNA, 63 nt, Homo sapiens
auuuaauugugauuuuaucaccuuucccauuucuuuccccacaagcuggcauuucaguaguug

SEQ ID NO: 1861 - RNA, 63 nt, Homo sapiens
auuuagcugaugagccaucuugauguagcugaucucucagggauagaagauauuucucaugaa

SEQ ID NO: 1862 - RNA, 63 nt, Homo sapiens
auuuaguugacuguauuauuugauuucggauugaaugaauguaaauagaaauuaaaugcaaau

SEQ ID NO: 1863 - RNA, 63 nt, Homo sapiens
auuuaugaaaggacacacacuggagagaaacccuaugaauguaagaaauguggaaaagcguuc

SEQ ID NO: 1864 - RNA, 63 nt, Homo sapiens
auuuauuauuuauuuauuauuuauuuauuuacagaugaauguauuuauuugggagaccggggu

SEQ ID NO: 1865 - RNA, 62 nt, Homo sapiens
auuuauuuuugcucuaugacacuugcaaaaaucucuacuguaauuaauuugggucuauuauu

SEQ ID NO: 1866 - RNA, 62 nt, Homo sapiens
auuucaaguguuccuugccacauguggccugugacuacuguauuggacaguucaguacuaga

SEQ ID NO: 1867 - RNA, 62 nt, Homo sapiens
auuucacuuucugaucacgguacguccauaaagccaguauuacacuuaaaugaaguauucuu

SEQ ID NO: 1868 - RNA, 64 nt, Homo sapiens
auuucauauugcuuccuccucccuggauaggaccuaauguagcacagcgggacucaaagaggag

SEQ ID NO: 1869 - RNA, 62 nt, Homo sapiens
auuucauggcagauauguaagaaaggaaauggcccuacuguagacagcuuauggggcccaga

SEQ ID NO: 1870 - RNA, 63 nt, Homo sapiens
auuuccugcacuguguucucagguacaugagcaaucucagggauagccagcagcagcuccagg

SEQ ID NO: 1871 - RNA, 61 nt, Homo sapiens
auuucuauuuuuguuauccugugauuauuuugauggugcuagugacuaguuucuuugcuuu

SEQ ID NO: 1872 - RNA, 63 nt, Homo sapiens
auuucuucacugugacagcaaagauuuaaauaagaugaauguaaaagagaaagcuuauuggac

SEQ ID NO: 1873 - RNA, 63 nt, Homo sapiens
auuucuucugaacucacgcucugcaaagccagggcugaauguaucuaccauaccugcuuguuu

SEQ ID NO: 1874 - RNA, 64 nt, Homo sapiens
auuugagugccuuacugaaugcauuuaccagcaaacauguagcaaucuguucucucauugugau

SEQ ID NO: 1875 - RNA, 61 nt, Homo sapiens
auuugagugcugaaauauuuccagaaucaaugguggugcuaaacuaucuccauguuucuag

SEQ ID NO: 1876 - RNA, 63 nt, Homo sapiens
auuugagugggaaagauacaaagcacacaguugucuccccacauuaggaagaguagugugcau

SEQ ID NO: 1877 - RNA, 62 nt, Homo sapiens
auuugaugguugacuuaauuggcaccauaacuuuguaugauauuauacauuaaccuuuauuu

SEQ ID NO: 1878 - RNA, 63 nt, Homo sapiens
auuugcauguuuuuuguuaauuuagcuaaagcaauugaauguagauacucagaagaaauaaaa

SEQ ID NO: 1879 - RNA, 62 nt, Homo sapiens
auuuggaagcuauuguuuuuuccuaaauaaaucucuacuguaucuauuucuuaggaaagucc

SEQ ID NO: 1880 - RNA, 63 nt, Homo sapiens
auuugggauacuaaaguaguuuaagucuccuuuacugaauguaagggggggaucgaaaagaag

SEQ ID NO: 1881 - RNA, 61 nt, Homo sapiens
auuuggguauuauugaaaauauuuuccaugccuuggugcuagcauauaaguuuggaaguuu

SEQ ID NO: 1882 - RNA, 62 nt, Homo sapiens
auuuguauuaauuuaagacuauuuuuguaaagcucuacuguaaauaaaauauuuuauaaaac

SEQ ID NO: 1883 - RNA, 61 nt, Homo sapiens
auuuguccauuuaaaaaugaucuguaguuuuuuuggugcuauaacauucugacacauauca

SEQ ID NO: 1884 - RNA, 64 nt, Homo sapiens
auuuguuaucaaacuguuuccuuauccucuuuucugauguagcauaaaaauugucccgguuuga

SEQ ID NO: 1885 - RNA, 62 nt, Homo sapiens
auuuuaaauuuacauaggcacaaguggcuaguggcuacuguauugacauucugggucuagga

SEQ ID NO: 1886 - RNA, 62 nt, Homo sapiens
auuuuaccaagaacauuuaagugccucagcaucuguaugauauaguggagcaggugcugaca

SEQ ID NO: 1887 - RNA, 62 nt, Homo sapiens
auuuucagguaucuuuauagcaaugccccacucccaguauuaauuuucuguauuaguccauu

SEQ ID NO: 1888 - RNA, 62 nt, Homo sapiens
auuuucucccguauuuguuaccuuccugaggccucaguauuagucgugagcacaaaguuuug

SEQ ID NO: 1889 - RNA, 63 nt, Homo sapiens
auuuugugccauuucugggagcauuuacagaugaauccccacacuuagccauugaauguaaag

SEQ ID NO: 1890 - RNA, 62 nt, Homo sapiens
auuuuuccaacgagggaacuuauuccgcacgggccuacuguaggaccauugucucguguaau

SEQ ID NO: 1891 - RNA, 63 nt, Homo sapiens
auuuuugcauugccuucgguuuguauuuagugucuugaauguaagaacaugaccuccguguag

SEQ ID NO: 1892 - RNA, 62 nt, Homo sapiens
auuuuuuucuauagugaacucugugggcgucucccaguauuacccuggaugauaggaauuga

SEQ ID NO: 1893 - RNA, 62 nt, Homo sapiens
caaaaaauuagguacaugauaacugguaccuuaucuacuguaaauauuucauuaaaaaugau

SEQ ID NO: 1894 - RNA, 63 nt, Homo sapiens
caaaaacagaaaacaaacaaacaaaaaacaaaaaauccccacaacuuugucaaauaauguaca

SEQ ID NO: 1895 - RNA, 63 nt, Homo sapiens
caaaaauggacugcccacuuccaugcugagugaugcucagggaagugaugcccgcagaaggcg

SEQ ID NO: 1896 - RNA, 64 nt, Homo sapiens
caaaagcgauuauuauuuuagagcaucucauuuauaauguagcagcucauaaaugaaauugaaa

SEQ ID NO: 1897 - RNA, 62 nt, Homo sapiens
caaaauaaccaugacaccaagguuaugaaauagacuacuguacacgucuaccuagguucaaa

SEQ ID NO: 1898 - RNA, 63 nt, Homo sapiens
caaaauagcaccuuacaccccaucuuugacucaguuccccacacccaaagaucccagccuagg

SEQ ID NO: 1899 - RNA, 63 nt, Homo sapiens
caaaaugagaugcacucauuuaaaucugcauucagugaauguauugggagaaaaauaggucuu

SEQ ID NO: 1900 - RNA, 63 nt, Homo sapiens
caaaauuuuuacuccaacacccccucaacccuuuucucagggaccacaccucuucuucccaag

SEQ ID NO: 1901 - RNA, 62 nt, Homo sapiens
caaacaauggaagaacuugcauuuuuauggaacucaguauuaaaagaaaaauauaaugugaa

SEQ ID NO: 1902 - RNA, 62 nt, Homo sapiens
caaacuaaaauguaucuagugauaaacuguaccacuacuguaccccauauguucaguucuau

SEQ ID NO: 1903 - RNA, 63 nt, Homo sapiens
caaagaacugccccaucuccucccauggccuucccuccccacaguccucacagccucucccuu

SEQ ID NO: 1904 - RNA, 63 nt, Homo sapiens
caaagcauugaaagccgaaaagagaagaaagcugacucagggaaagguguugacagggagacu

SEQ ID NO: 1905 - RNA, 63 nt, Homo sapiens
caaagccuucguuguauguugacgaugcacuuuuaugaauguaguuucuaucgcuguuuuuag

SEQ ID NO: 1906 - RNA, 64 nt, Homo sapiens
caaagcuaaucugaauucuguaggcuaaaaauauucauguagcaaaucugagaauugaaaacug

SEQ ID NO: 1907 - RNA, 64 nt, Homo sapiens
caaagggcuagaacucuccaaggucuugcccccggcauguagcaccaccugagccagaaacugc

SEQ ID NO: 1908 - RNA, 64 nt, Homo sapiens
caaaguacagcacauaccauuuugugucuaauaacaauguagcacaguaaugacuguacauguc

SEQ ID NO: 1909 - RNA, 63 nt, Homo sapiens
caaagucguuucaacucuuaaagacaucuuaauccugaauguaaacaauuguuauguguuuag

SEQ ID NO: 1910 - RNA, 62 nt, Homo sapiens
caaaguguauauaggcuguuuacucuuacauuuccuacuguaagauacagauuuaugguacu

SEQ ID NO: 1911 - RNA, 63 nt, Homo sapiens
caaauacuuagaacuggaaggcucuuuguuauuauugaauguaccccucagccuucucagcau

SEQ ID NO: 1912 - RNA, 63 nt, Homo sapiens
caaauauaguuggcauuggaaguuuagccuuuacuugaauguauacuguagauuuuuaacaaa

SEQ ID NO: 1913 - RNA, 63 nt, Homo sapiens
caaauuccuguacauagagauauauuuuuuaagugugaauguaacaacauacugugaauucca

SEQ ID NO: 1914 - RNA, 63 nt, Homo sapiens
caacaaagaggggaugaaucacccuuggcccagccuccccacaaagccugacccugggcaggu

SEQ ID NO: 1915 - RNA, 62 nt, Homo sapiens
caacacuuugugucacuaccuccucuaaugguuaguaugauaugcuagcagacuguaugagg

SEQ ID NO: 1916 - RNA, 63 nt, Homo sapiens
caacagcaccauccucuguagcagacaggccucccuccccacaggcccgcugcugcggccucu

SEQ ID NO: 1917 - RNA, 63 nt, Homo sapiens
caacaucaaagaauucauaccagugugaaacccuaugaauguaaggaauguguaaagaccuuu

SEQ ID NO: 1918 - RNA, 63 nt, Homo sapiens
caacaucaaagaauuccuacuggugagaaacccuaugaauguaaugaaugugagaaggccucu

SEQ ID NO: 1919 - RNA, 49 nt, Homo sapiens
caaccagcgcuccagauaacccucagggaaccagcacuucccaaaccgc

SEQ ID NO: 1920 - RNA, 63 nt, Homo sapiens
caaccuuagauggagagguggcucugagauuagcauccccacaggcccaccucuggcuggaga

SEQ ID NO: 1921 - RNA, 62 nt, Homo sapiens
caaccuuauauggguugcuuuugcuuucacaccuguaugauagucauggaaacugaagccca

SEQ ID NO: 1922 - RNA, 63 nt, Homo sapiens
caacuggaauagcuaauuacagucuauuaaaacugugaauguauguagcaauccugcguguga

SEQ ID NO: 1923 - RNA, 63 nt, Homo sapiens
caacuggccuucugcccugcagccuccguccuggccucagggacgcuggaucccaaaugagag

SEQ ID NO: 1924 - RNA, 62 nt, Homo sapiens
caagaacugcauggaccuaacauucgaucucauucaguauuaaaggggggagggggaggggg

SEQ ID NO: 1925 - RNA, 61 nt, Homo sapiens
caagaagcugagcuggcagagagcuccaccauuuggugcuaaaaaaaaaaacguccugagg

SEQ ID NO: 1926 - RNA, 62 nt, Homo sapiens
caagaaggcagcauuguaggauuaacauucuugucuacuguauauuaucuuggaaggcucuu

SEQ ID NO: 1927 - RNA, 62 nt, Homo sapiens
caagacacaacuauuaagacgaugaaggcaucgacaguauuaaugucaggugaucugaaaua

SEQ ID NO: 1928 - RNA, 61 nt, Homo sapiens
caagagcuccacguuuuggcuucgagcaaguuuuggugcuacuguuuuugcaguuuugggc

SEQ ID NO: 1929 - RNA, 63 nt, Homo sapiens
caagauuucuuuauuuacaaaugauuacauuuaaaugaauguacauucuucucacugacuuug

SEQ ID NO: 1930 - RNA, 63 nt, Homo sapiens
caagccagcccccaagacccuggggguggacaccacucagggaaaccuggggugggggugggc

SEQ ID NO: 1931 - RNA, 63 nt, Homo sapiens
caagcuguggggaggacucugccuguguccuguguuccccacagggagaggcucuggggggau

SEQ ID NO: 1932 - RNA, 63 nt, Homo sapiens
caaggcccagaccuggccucugccauccucccuguuccccacagguccuccaucaccccuggu

SEQ ID NO: 1933 - RNA, 62 nt, Homo sapiens
caagguuacuucaucuucauucauuauuaccugacaguauuaaacuacuacucaauaauuuu

SEQ ID NO: 1934 - RNA, 63 nt, Homo sapiens
caaguaaucuagaagaauguggauacucuuaggcgugaauguaaaugccuuaauauugaaggu

SEQ ID NO: 1935 - RNA, 61 nt, Homo sapiens
caaguacuagguuguccauuuaugguaccuauuuggugcuaguaaauuuucaaacuagauu

SEQ ID NO: 1936 - RNA, 62 nt, Homo sapiens
caaguagcacugaguuucuuaggaaauuugucuucaguauuaggucuccaacucuuguaaaa

SEQ ID NO: 1937 - RNA, 63 nt, Homo sapiens
caagucacuacagcaucuggagccccuaggagauacucagggaagcaaauccuuguuugggcu

SEQ ID NO: 1938 - RNA, 64 nt, Homo sapiens
caagucguagcacuuuguuucagaacuggaauggagauguagcacucaugucgucccgagucaa

SEQ ID NO: 1939 - RNA, 62 nt, Homo sapiens
caagugcuuuaguaguaguuuaaaguaguaacugcuacuguauuuagugggguggaauucag

SEQ ID NO: 1940 - RNA, 63 nt, Homo sapiens
caaguuaguuuuguggcuuuccaucugacccuaugugaauguaaggugaugugaccuuguugg

SEQ ID NO: 1941 - RNA, 63 nt, Homo sapiens
caauauucuaguacuuucugaacauucuggaauccuccccacauucuagaauucucccaacau

SEQ ID NO: 1942 - RNA, 63 nt, Homo sapiens
caaucaaaccacccaguuaaccuggacuguacugccucagggauuuagagauagcccccaccu

SEQ ID NO: 1943 - RNA, 62 nt, Homo sapiens
caauccaagauuagacuacacaaaagcuuccuuccaguauuaaacaaaaagaauuaaacaua

SEQ ID NO: 1944 - RNA, 63 nt, Homo sapiens
caauggaauauuuucuaaaacauuuaguauacauuugaauguauuuuaaaccaugccaaacua

SEQ ID NO: 1945 - RNA, 61 nt, Homo sapiens
caauuauaauuacaucugugauuucugaacuaauggugcuaauucagagaaauggaaagug

SEQ ID NO: 1946 - RNA, 62 nt, Homo sapiens
caauucuguaaguggugacuuuuugagcaccuuucaguauuauguauuuguaaaaaccauug

SEQ ID NO: 1947 - RNA, 63 nt, Homo sapiens
caauuucaguccagcguuaagaacuuaguuuuggucucagggagaaggauagggagauggaaa

SEQ ID NO: 1948 - RNA, 63 nt, Homo sapiens
caauuuucaguauuuuaacuaccucaauaaugcuaugaauguaagauauugggauagagaucc

SEQ ID NO: 1949 - RNA, 62 nt, Homo sapiens
caauuuugaaaagaauagaggaaacacccucacuguaugauauaaaguuauagucauuuaaa

SEQ ID NO: 1950 - RNA, 61 nt, Homo sapiens
cacaaacccuucacagacugcucuggugccugguggugcuagcuccucccaccucagcacc

SEQ ID NO: 1951 - RNA, 61 nt, Homo sapiens
cacaaaugcaaagggcauguaaauagguaaugguggugcuaguagcaaauugguagauagu

SEQ ID NO: 1952 - RNA, 63 nt, Homo sapiens
cacaaaugugacccaggauacagaguguugcuguccucagggagguccgaucuggaacacaua

SEQ ID NO: 1953 - RNA, 61 nt, Homo sapiens
cacaacccagguguggagagaagagagguagaauggugcuaguuuccuauuuuauuuuugu

SEQ ID NO: 1954 - RNA, 62 nt, Homo sapiens
cacaagacuggcccagugccagcaaguccuuaggcuacuguaaugcugccucaggacccauc

SEQ ID NO: 1955 - RNA, 62 nt, Homo sapiens
cacacaacauguaagcauguaagaguaaagaauuguaugauauguuccuuuuuucaguucac

SEQ ID NO: 1956 - RNA, 63 nt, Homo sapiens
cacacacaugcaggcggcguggucucccugcucuguccccacacguuccucacauacaggcaa

SEQ ID NO: 1957 - RNA, 63 nt, Homo sapiens
cacacuauggggccccagcgacgugucugguugagcucagggaauaugguucuuagccaguuu

SEQ ID NO: 1958 - RNA, 61 nt, Homo sapiens
cacacuccauaauaaucuacuuacuagaaauaguggugcuaccacaaaaaauguuaaccau

SEQ ID NO: 1959 - RNA, 61 nt, Homo sapiens
cacacucucaccuaggugagcgcauugagccaguggugcuaaaugcuacauacuccaacug

SEQ ID NO: 1960 - RNA, 63 nt, Homo sapiens
cacagaaauacauuaagugggcuggucucauguaguccccacaucauugcaaauuacaaacca

SEQ ID NO: 1961 - RNA, 63 nt, Homo sapiens
cacagccuucaugcccccugaccccaggccgacccuccccacacccuaggguaccccagucgu

SEQ ID NO: 1962 - RNA, 64 nt, Homo sapiens
cacaggccagaggcagggccaaugguuucccacaaaauguagcacaacgaaggucagaauucgu

SEQ ID NO: 1963 - RNA, 63 nt, Homo sapiens
cacagggggccccaguccagguggccuaacagcaucucagggaauguccaucuggagcuggca

SEQ ID NO: 1964 - RNA, 63 nt, Homo sapiens
cacaguguaauauuucuccaaguaucauccaaaauuccccacagacaaggcuuucguccucau

SEQ ID NO: 1965 - RNA, 63 nt, Homo sapiens
cacaguguuccagcugccugggaggcuuuuggugguccccacagccucugggccaagacuccu

SEQ ID NO: 1966 - RNA, 62 nt, Homo sapiens
cacauaacauuguaugcauggaaacauggaggaacaguauuacaguguccuaccacucuaau

SEQ ID NO: 1967 - RNA, 64 nt, Homo sapiens
cacauacguuccucguucuucuuagaggccauuugcauguagcagaaagggcaccuaggucaag

SEQ ID NO: 1968 - RNA, 63 nt, Homo sapiens
cacaucccauacccucuucucccuacccaucccauuccccacaggcccuacauuaacaagguu

SEQ ID NO: 1969 - RNA, 63 nt, Homo sapiens
cacaucuuucuuauuaguuuacagugaaauguuaucucagggacauucaaacaaaggaggagg

SEQ ID NO: 1970 - RNA, 63 nt, Homo sapiens
cacaucuuucuucuuaguuuacagugaaauauuaucucagggauauuuuuuuuuuuuuuuuga

SEQ ID NO: 1971 - RNA, 63 nt, Homo sapiens
cacaugcuuuaagauuucuauccaucuuucagaguugaauguaauaauguuugguauuuaauu

SEQ ID NO: 1972 - RNA, 64 nt, Homo sapiens
cacauuagguauaauuuaucauuuaucugaaaucacauguagcagauugcauagucuguaaucc

SEQ ID NO: 1973 - RNA, 63 nt, Homo sapiens
cacauugaucuaucuaaaccugguggggagaauuauccccacauugucucauggaaagacuca

SEQ ID NO: 1974 - RNA, 62 nt, Homo sapiens
caccaaacucuugucuauauuuaccuuuguaccacaguauuaaucgcuauuguucauguauc

SEQ ID NO: 1975 - RNA, 63 nt, Homo sapiens
caccacacagcagaauuucuaauggaaguuuguugugaauguaaaggagggagcauucuuugc

SEQ ID NO: 1976 - RNA, 62 nt, Homo sapiens
caccacuuuauauccacaaaggcaaauaacuaauguaugauaauagaauaauuugcacuaau

SEQ ID NO: 1977 - RNA, 63 nt, Homo sapiens
cacccaaaucucauguugaauuguaguucccauaauccccacauguugugggagggacccagu

SEQ ID NO: 1978 - RNA, 63 nt, Homo sapiens
caccccacuuccagcagaguccugccuccucccaauccccacagacacacacauugauccucc

SEQ ID NO: 1979 - RNA, 62 nt, Homo sapiens
cacccccaaacccccaucccuuccccaccuccagcaguauuacuuguaacgcaauucaggga

SEQ ID NO: 1980 - RNA, 63 nt, Homo sapiens
cacccccacagcacccccacaauguaggaaaagaccucagggaaccucucccuggaaagacgg

SEQ ID NO: 1981 - RNA, 64 nt, Homo sapiens
cacccucacgccauuuccagggaacagacugcggguauguagcaguguagucuuuaaccugcuc

SEQ ID NO: 1982 - RNA, 63 nt, Homo sapiens
caccgugaaccagaggguguggcuuuccaggcacccucagggagccuccccaucuguccagcu

SEQ ID NO: 1983 - RNA, 63 nt, Homo sapiens
caccguguguccuccccuccccucccuuccucuccuccccacaggcggaauugcuuucuucug

SEQ ID NO: 1984 - RNA, 63 nt, Homo sapiens
caccguuuuggguucagauggacaugaaauugaaucucagggauccaacuuucuagcaaugua

SEQ ID NO: 1985 - RNA, 63 nt, Homo sapiens
caccuggcaggugcacaccaugugcaugagucacuuccccacagugcucagagaagcaaaccu

SEQ ID NO: 1986 - RNA, 63 nt, Homo sapiens
cacgcccgagaaagccugggggacccagacaccuguccccacagucaaagccuggggacccag

SEQ ID NO: 1987 - RNA, 63 nt, Homo sapiens
cacgccgugugucacgggcuagggcggcguguucauccccacaccgugugucacaacaggcua

SEQ ID NO: 1988 - RNA, 64 nt, Homo sapiens
cacgcucucugaauuuuauuaguuggacaauuccauauguagcauucugcuucaauauuaucuc

SEQ ID NO: 1989 - RNA, 62 nt, Homo sapiens
cacguauuuugcaaaagcuacuuuuccuaguuuucaguauuacuuucauguuuuaaaaaucc

SEQ ID NO: 1990 - RNA, 63 nt, Homo sapiens
cacgugaauugagucgccuggcggcucuguacgcgcucagggaagcuuagcuucuuggugccc

SEQ ID NO: 1991 - RNA, 62 nt, Homo sapiens
cacguuucauggacuguuaccaacaaagaaaagucaguauuauguuguucucagacacuuug

SEQ ID NO: 1992 - RNA, 63 nt, Homo sapiens
cacuaacgacuucagggcagggcucugauauuccaugaauguaucaggaaauauauaugugug

SEQ ID NO: 1993 - RNA, 61 nt, Homo sapiens
cacuaucuuaauuuugcgauacacugcauuugcuggugcuauuuuuauacagugaagcaac

SEQ ID NO: 1994 - RNA, 63 nt, Homo sapiens
cacucaaaucucaucuugaauuguaguuccaauaauccccacaugucaugggaggaacccagu

SEQ ID NO: 1995 - RNA, 62 nt, Homo sapiens
cacuccacccccuuccaggucccugaggcugguucuacuguauccccaucaccuccacaacu

SEQ ID NO: 1996 - RNA, 61 nt, Homo sapiens
cacucgguugucuuuacuuuuaaaaguaauacuuggugcuaagaauuucaggauuauugua

SEQ ID NO: 1997 - RNA, 63 nt, Homo sapiens
cacugcccaugcauaagcagaacagccuggccuuuugaauguauuuuccuggguuuuuucccc

SEQ ID NO: 1998 - RNA, 63 nt, Homo sapiens
cacugcccccuccacuggaggggucuccucugcagcucagggacuggcacacuggccuccaga

SEQ ID NO: 1999 - RNA, 63 nt, Homo sapiens
cacugccugggggcucuagucauuccaguggaagaugaauguaaucugcauggugaugugaca

SEQ ID NO: 2000 - RNA, 63 nt, Homo sapiens
cacugccuucguuuauauuuuuuuaacugugauaauccccacaggcacauuaacuguugcacu

SEQ ID NO: 2001 - RNA, 64 nt, Homo sapiens
cacuguaacagaaaacacaauauguauauaacauuuauguagcaauaaaugugccaucuuuuuu

SEQ ID NO: 2002 - RNA, 63 nt, Homo sapiens
cacugugccuucauuuuccagcccacagccugggucucagggaucuugagggguagaacaugu

SEQ ID NO: 2003 - RNA, 62 nt, Homo sapiens
cacuguuguucagcuaucaccuuaauuguguaugauaugauaaauguuuagcaguaaagcua

SEQ ID NO: 2004 - RNA, 62 nt, Homo sapiens
cacuugauuaaaugucuguaaaucuucaucauuccuacuguaguuuauuuaauaucuauugu

SEQ ID NO: 2005 - RNA, 63 nt, Homo sapiens
cacuuguccguagggucacacgcgugcccuguugcugaauguauguugcguaucccaaggcac

SEQ ID NO: 2006 - RNA, 61 nt, Homo sapiens
cacuuucucugccacagcuguucuucacaguguuggugcuaaugaggccagggugcagggu

SEQ ID NO: 2007 - RNA, 63 nt, Homo sapiens
cagaaaaauugacauugcugccuuuaagaauaccaugaauguaagaaauugaaagaaauugua

SEQ ID NO: 2008 - RNA, 62 nt, Homo sapiens
cagaaaacaaacuuuuauauccuucucaugucuucuacuguaaaauucauaugcuuugcuac

SEQ ID NO: 2009 - RNA, 50 nt, Homo sapiens
cagaacacuagcaccaugaaacuccccacacaguuuuacagaguucugaa

SEQ ID NO: 2010 - RNA, 63 nt, Homo sapiens
cagaacauuccagcacuuucuaucuggccuccuuguccccacacuacgcccccccacccucgc

SEQ ID NO: 2011 - RNA, 61 nt, Homo sapiens
cagaacccaacccuauaccuuuuacuucuuaaauggugcuaaccacaggugucccagggug

SEQ ID NO: 2012 - RNA, 63 nt, Homo sapiens
cagaacuuucccuggcagggaggggauggcagaaacucagggaggggcuuggggcccauugua

SEQ ID NO: 2013 - RNA, 62 nt, Homo sapiens
cagaauugaaccaacccaaccccuagcucaccuccuacuguaaagagaaugcacugguccug

SEQ ID NO: 2014 - RNA, 62 nt, Homo sapiens
cagaauuugaaguuuggcuagcauccauacuuuucuacuguaaauauuucacucuccucuag

SEQ ID NO: 2015 - RNA, 62 nt, Homo sapiens
cagacucugaaagcccugacuugguucuuggcuucuacuguacuaguuacuaguuacuggua

SEQ ID NO: 2016 - RNA, 63 nt, Homo sapiens
cagagaggacaaugcauccuucagcgugguggagccucagggacagaucugaugaucccagga

SEQ ID NO: 2017 - RNA, 62 nt, Homo sapiens
cagagauaacacuucccaacucauuuugugaggccaguauuacccuaauagcaaaaccaggc

SEQ ID NO: 2018 - RNA, 57 nt, Homo sapiens
cagagcccugcugaagugaaauaucuggucucagggauugcuccuauguauucagca

SEQ ID NO: 2019 - RNA, 63 nt, Homo sapiens
cagagcggccucuccccacgcccggggcgcgccggcucagggaggcucggggccgcccaugca

SEQ ID NO: 2020 - RNA, 63 nt, Homo sapiens
cagaggaaggacagagggugggcgcagggcaccaacucagggacauccccucuccugggcgac

SEQ ID NO: 2021 - RNA, 63 nt, Homo sapiens
cagaggaucaucucugaggaggaagguggugacaacucagggaacacgaacaccccaccuuuu

SEQ ID NO: 2022 - RNA, 63 nt, Homo sapiens
cagaggcucgaggggcucagggccucaggcacccguccccacacgagggccccgugggugggc

SEQ ID NO: 2023 - RNA, 63 nt, Homo sapiens
cagaguuagaacggagcccucggugaugcggacaucucagggaaacuugcguacucagcacag

SEQ ID NO: 2024 - RNA, 63 nt, Homo sapiens
cagaguuguuauuguauaaauggauauuaaguuaaugaauguaagguaugucguuauauauau

SEQ ID NO: 2025 - RNA, 63 nt, Homo sapiens
cagauacaaacuacuaaacuaaaaagcaaacacagcucagggaaagacaaucagugcaagagg

SEQ ID NO: 2026 - RNA, 63 nt, Homo sapiens
cagauagaaauaauucucauuggagauaaacccuaugaauguaaacacauaguaaagccuuaa

SEQ ID NO: 2027 - RNA, 63 nt, Homo sapiens
cagaucccaguucgucugaggcaacccucuguggacucagggaaccugagcugaggacuuugg

SEQ ID NO: 2028 - RNA, 63 nt, Homo sapiens
cagaucuuaacaauuccaauagaagagaagacauaugaauguaaggaaugugggaaaaucuug

SEQ ID NO: 2029 - RNA, 62 nt, Homo sapiens
cagaugagacauauuaacuuagacuaaacgugaacaguauuauauggacucucacaacgcuc

SEQ ID NO: 2030 - RNA, 62 nt, Homo sapiens
cagauuauuugaaucacacaggaugauguguuaacaguauuaggguggaagaggaaucaaga

SEQ ID NO: 2031 - RNA, 63 nt, Homo sapiens
cagcaacaacccucacauaugcacugagugaaggaugaauguauggacacaucugggaguauu

SEQ ID NO: 2032 - RNA, 63 nt, Homo sapiens
cagcaagacugaaggcaggaguacuaguuaggagauccccacaggcuuuacacuagagacagu

SEQ ID NO: 2033 - RNA, 63 nt, Homo sapiens
cagcacugaguggucaaaauacauuucugggccaccucagggaacccaugcaucugccuggca

SEQ ID NO: 2034 - RNA, 63 nt, Homo sapiens
cagcacuucauggacccuggggaggccccgcccccuccccacaccccugcuccccacugccgc

SEQ ID NO: 2035 - RNA, 63 nt, Homo sapiens
cagcagcagcagcagcacaaacauugcugccuuuguccccacacagccucuaagcgugcugac

SEQ ID NO: 2036 - RNA, 63 nt, Homo sapiens
cagcagucagggacagacauacauuucucauaccuuccccacaucugagagaugacagggaaa

SEQ ID NO: 2037 - RNA, 63 nt, Homo sapiens
cagcaucaaagaauucacacaggagagaaagcacaugaauguaaugaauguggaaaagcuuuc

SEQ ID NO: 2038 - RNA, 63 nt, Homo sapiens
cagcaucacaaaaugcauaggaaagagaaaucguaugaauguaaugaguaugagggcaguuuc

SEQ ID NO: 2039 - RNA, 63 nt, Homo sapiens
cagcaucagagaguucacacuagagaaaggccuuaugaauguagugaaugugggaaauccuuu

SEQ ID NO: 2040 - RNA, 62 nt, Homo sapiens
cagcaucuaugacuuccuuuauuauucuaaaauaguaugauaagaauuaauagcaauaauaa

SEQ ID NO: 2041 - RNA, 63 nt, Homo sapiens
cagccaaaacugagggcccugugcaugcugguggccucagggacccucauaacccccagacuc

SEQ ID NO: 2042 - RNA, 63 nt, Homo sapiens
cagccacucugcuuagacaugggagcuauagggaccucagggagccccagcuucuuacccacc

SEQ ID NO: 2043 - RNA, 63 nt, Homo sapiens
cagccagauccggacccuucccuuaggguccagucuccccacaccccagcagggugucuucua

SEQ ID NO: 2044 - RNA, 63 nt, Homo sapiens
cagccagccccucacagcucuuccccagcuccgccuccccacacuccuccuugcgcacccacu

SEQ ID NO: 2045 - RNA, 63 nt, Homo sapiens
cagccagugcacagguauaagcagaacuacagagcugaauguagcuucccugggaucucuucu

SEQ ID NO: 2046 - RNA, 63 nt, Homo sapiens
cagcccacuccacccugccagcagcuuccggccaguccccacagccucaucagcucucuucac

SEQ ID NO: 2047 - RNA, 63 nt, Homo sapiens
cagccccacagcacccaggcuccauggggaagugcuccccacacgugcucgcagccuggcggg

SEQ ID NO: 2048 - RNA, 63 nt, Homo sapiens
cagccccucagccauccagggcuacccacugcuuacucagggaccaggcagcccccauggcag

SEQ ID NO: 2049 - RNA, 63 nt, Homo sapiens
cagcccuuccuauuuccuuuccuauuuuuuuuuucuccccacacuuucuugggacucccaccu

SEQ ID NO: 2050 - RNA, 61 nt, Homo sapiens
cagccgaggggacccugcucacagccuucuacauggugcuacugcucuuggaguggacaug

SEQ ID NO: 2051 - RNA, 62 nt, Homo sapiens
cagccucccaaaguacugggauuauaggugugagcuacuguacccagccuuaaccuguuuca

SEQ ID NO: 2052 - RNA, 63 nt, Homo sapiens
cagccuccuccuggaccucuuggcccccagccccuuccccacacagccccagaagggucccag

SEQ ID NO: 2053 - RNA, 63 nt, Homo sapiens
cagccuccugggcaccccagaggcaaggcugugcacucagggagggagggugggacacagagg

SEQ ID NO: 2054 - RNA, 63 nt, Homo sapiens
cagccugaggacuccaggacccaauucuccacuugcucagggacuggccccuggcucuucugg

SEQ ID NO: 2055 - RNA, 61 nt, Homo sapiens
cagccugggugcacaguagcugcaacuccccauuggugcuaccuggcucuccugucucugc

SEQ ID NO: 2056 - RNA, 63 nt, Homo sapiens
cagcgccuccucccaggguggcugggccuccuguucucagggaucacaccugggugaggggcc

SEQ ID NO: 2057 - RNA, 61 nt, Homo sapiens
cagcuacaacaacagcugagaucacuuaauaaauggugcuaaacuccucucccucucugga

SEQ ID NO: 2058 - RNA, 63 nt, Homo sapiens
cagcuccgcggacccauggacaagcccagccccgccucagggaaaacagggccuuucccuaca

SEQ ID NO: 2059 - RNA, 63 nt, Homo sapiens
cagcugggcuucccaccaggcuuucccgcgggggucucagggagcuucuccccagcgcugcuc

SEQ ID NO: 2060 - RNA, 62 nt, Homo sapiens
cagcuguuguguaaauacuguauauugcaaaaaucaguauuauuuuaagagauguguucuca

SEQ ID NO: 2061 - RNA, 61 nt, Homo sapiens
cagcuucacauaccccucuccauguaugagaucuggugcuagcaaucagauucaacccgaa

SEQ ID NO: 2062 - RNA, 64 nt, Homo sapiens
cagcuuccuugugugggacugagaagcaagauaucaauguagcagaauugcacuugugccucac

SEQ ID NO: 2063 - RNA, 63 nt, Homo sapiens
caggaagauggaagcaucagaggauuaaaaaccuuuccccacagaaaugugggcaagaagaca

SEQ ID NO: 2064 - RNA, 63 nt, Homo sapiens
caggaccagccuucccuuaucuaaggggcauggagcucagggaggcuuuauuccauaugcacg

SEQ ID NO: 2065 - RNA, 61 nt, Homo sapiens
caggaccccuuuugucucugggaccagacuuguuggugcuaccccuuacuccccucugcaa

SEQ ID NO: 2066 - RNA, 63 nt, Homo sapiens
caggacuguguggguuucuuaccugccugagccaccucagggaaucuuccagccuaaugcagg

SEQ ID NO: 2067 - RNA, 62 nt, Homo sapiens
caggagacacggucccaggcacugcacaggccugcaguauuaccaggcggaggggcugcuuu

SEQ ID NO: 2068 - RNA, 63 nt, Homo sapiens
caggagcggggccugggagcugagggcgucucaucuccccacaggcaucugcugcugcuccug

SEQ ID NO: 2069 - RNA, 62 nt, Homo sapiens
caggaggugaaggcugcaaugagccaugauuacacuacuguaccccagccugggcaacagag

SEQ ID NO: 2070 - RNA, 62 nt, Homo sapiens
caggaguuagaauucucucagaagggucuaugaucaguauuacuuuauuaagaauuaccuuu

SEQ ID NO: 2071 - RNA, 63 nt, Homo sapiens
caggaucuuccucaauacugcuccucucuucucagcucagggagaggaggggauccauucucu

SEQ ID NO: 2072 - RNA, 62 nt, Homo sapiens
caggccacagccccuggcuuugugcccacuuaggcaguauuaucaacaagguccugcucagu

SEQ ID NO: 2073 - RNA, 63 nt, Homo sapiens
caggccccugugcuccaggccgaggcugggcuacccucagggagauccagagacucaugccca

SEQ ID NO: 2074 - RNA, 63 nt, Homo sapiens
caggcccuguccagcccccagugcgcucguuccgguccccacagacugccccagccaacgaga

SEQ ID NO: 2075 - RNA, 63 nt, Homo sapiens
caggcgauacaucugaguucaaaugucuucccaggcucagggaccuccauuccuugagauugu

SEQ ID NO: 2076 - RNA, 63 nt, Homo sapiens
caggcggacuagccuggcuggaccaugaggcugucuccccacagcuuuauccaagccuccaag

SEQ ID NO: 2077 - RNA, 63 nt, Homo sapiens
caggcuccagggcacucggaggcuggugggguggacucagggaggcccagggcuccucugguc

SEQ ID NO: 2078 - RNA, 63 nt, Homo sapiens
caggcugucagugaaagcccguaucugucuccaggugaauguaauuuacuuccgaguacuuua

SEQ ID NO: 2079 - RNA, 63 nt, Homo sapiens
cagggaagauacauacauauaugagguacaguuuuugaauguacugguaaugccuaauguggu

SEQ ID NO: 2080 - RNA, 64 nt, Homo sapiens
cagggaguuugggcuugguuuugaacuuuccuuucaauguagcaaagcauuccuaguuaaccag

SEQ ID NO: 2081 - RNA, 63 nt, Homo sapiens
cagggcagcccccccaggggucaggcagcugugucuccccacacuggcuccccaguauucugg

SEQ ID NO: 2082 - RNA, 63 nt, Homo sapiens
cagggcaggaggagggggccgugccucccacccuucucagggacccccacgccuuuguuguuu

SEQ ID NO: 2083 - RNA, 63 nt, Homo sapiens
cagggcaguccugcugcucugggaugggcugcccccucagggaggacuggccagcuggguggc

SEQ ID NO: 2084 - RNA, 63 nt, Homo sapiens
cagggcuuuggcuguuaccuuucccugcugaggggcucagggaaaagggucggggauucucag

SEQ ID NO: 2085 - RNA, 61 nt, Homo sapiens
caggggcaccccgacauccaggccacccccucauggugcuacagacccugcccuggggccc

SEQ ID NO: 2086 - RNA, 61 nt, Homo sapiens
cagguaauaauaggcuugaaaauugauauccuguggugcuaaaguacaguagaaagagagg

SEQ ID NO: 2087 - RNA, 63 nt, Homo sapiens
cagguaggaaacauucacagaugaagacagcagauuccccacauucucaucuuuggccuguuc

SEQ ID NO: 2088 - RNA, 63 nt, Homo sapiens
cagguucucccucugcccuccacugggcccaguggcucagggaccuggggaaaggagauggag

SEQ ID NO: 2089 - RNA, 62 nt, Homo sapiens
caguaggcuuggggcagcuggguuuguccuugauguaugauacuguuauuauaauaauuauu

SEQ ID NO: 2090 - RNA, 63 nt, Homo sapiens
cagucaaauggcuucaugagaacaguagaaccuuaugaauguauacuagcauacaaggaucuc

SEQ ID NO: 2091 - RNA, 63 nt, Homo sapiens
cagucccagccagaagaaucucugaaagcauauugugaauguauacaauguaguacaaacaau

SEQ ID NO: 2092 - RNA, 63 nt, Homo sapiens
caguccuaaaaauggccagauuguggaacagcuguugaauguaauacuuccaaaauguacaua

SEQ ID NO: 2093 - RNA, 63 nt, Homo sapiens
caguccugccaccacccugucuuccucugcaagugcucagggaaauggccuucccgccggagg

SEQ ID NO: 2094 - RNA, 62 nt, Homo sapiens
cagucuagccaaaagcucaagugggacaauggcacaguauuaaggucaaggacaaaaacuua

SEQ ID NO: 2095 - RNA, 61 nt, Homo sapiens
cagugaucaggaguaaaucagcuggggcaggguuggugcuaugaaugaccacacugauuug

SEQ ID NO: 2096 - RNA, 63 nt, Homo sapiens
cagugcccucacucccugcuccccgcacccggagccucagggaugggcucaggcugaugguca

SEQ ID NO: 2097 - RNA, 62 nt, Homo sapiens
cagugccugucccccaggcccacuuguauucuuucuacuguaaaauggcgccuuuaaaaaag

SEQ ID NO: 2098 - RNA, 62 nt, Homo sapiens
cagugcggcuccacagcauggaaucugauguaugauaugauagaauguggcacuaaaugcag

SEQ ID NO: 2099 - RNA, 63 nt, Homo sapiens
cagugcuguaugcggcugcagccgucucaccuguuuccccacaaagggaauuucucacucugg

SEQ ID NO: 2100 - RNA, 63 nt, Homo sapiens
caguggaugaucuaggguagacaaggcaggguggccucagggagauuccaggccagcccaaac

SEQ ID NO: 2101 - RNA, 63 nt, Homo sapiens
caguguggugagguccuuaggugucccaagaacaacucagggagcacgggagggucugcaguu

SEQ ID NO: 2102 - RNA, 62 nt, Homo sapiens
caguguucuacugccugaugugaaagagagcuauguaugauaauuaaagaaaauaauuuucu

SEQ ID NO: 2103 - RNA, 61 nt, Homo sapiens
caguuauaccuaacauauuaugcaauuuucucuuggugcuaccugauggaauuccugcacu

SEQ ID NO: 2104 - RNA, 63 nt, Homo sapiens
caguuuccuacugccuuaggaggccccugcuugugcucagggaaggccucuucaugggcaugu

SEQ ID NO: 2105 - RNA, 62 nt, Homo sapiens
caguuuccucaccuaggaaauagggugaugauaucuacuguauagggcagguguuguaggag

SEQ ID NO: 2106 - RNA, 63 nt, Homo sapiens
cauaaaguggcagggagauacaauaucacaccccuuccccacaaggacugugaauauugggau

SEQ ID NO: 2107 - RNA, 62 nt, Homo sapiens
cauaauuaaacuauuucugcuauuauuuuuaaagcaguauuauuuuauaaccaauucuaaaa

SEQ ID NO: 2108 - RNA, 63 nt, Homo sapiens
cauaauuguucuuuuaaaauuauuggcaguauugcugaauguauuuagauuuuuucaccaagu

SEQ ID NO: 2109 - RNA, 62 nt, Homo sapiens
cauacacuucuuaaaaugugaaaaucuauguuuucaguauuaugacaguaucugcagauacu

SEQ ID NO: 2110 - RNA, 61 nt, Homo sapiens
cauacuagguucagucugaaagaaaucuccuaauggugcuauagagagggagguaacagaa

SEQ ID NO: 2111 - RNA, 62 nt, Homo sapiens
cauacuguuuauaaacugauuuucugguuuauuucuacuguaaucucucaauauucauagaa

SEQ ID NO: 2112 - RNA, 61 nt, Homo sapiens
cauagcagauuauauuugguuccugaauguuuguggugcuaauuucuguguuuguuccaag

SEQ ID NO: 2113 - RNA, 64 nt, Homo sapiens
cauaggcuagaaugugcagcucuuucuccaggugggauguagcaccccgaaguagagcuuucug

SEQ ID NO: 2114 - RNA, 61 nt, Homo sapiens
cauagugcugugucauccugguccauguaggacuggugcuaaccaccugccaucaugagga

SEQ ID NO: 2115 - RNA, 63 nt, Homo sapiens
cauauacugcacauacugaaauagagggaaaucacugaauguaaagagguuucaucuaugccc

SEQ ID NO: 2116 - RNA, 63 nt, Homo sapiens
cauauauauauauauauuaagccccaggcugaauacucagggacagcaauucacagccugccu

SEQ ID NO: 2117 - RNA, 62 nt, Homo sapiens
cauaugaagaccauaaaugugggaaagccuuugucaguauuaaucccuuaauugacauaagu

SEQ ID NO: 2118 - RNA, 62 nt, Homo sapiens
cauaugaagucaauaaaugugggaaagccuuugucaguauuaaucccuuaauugaccuaagu

SEQ ID NO: 2119 - RNA, 63 nt, Homo sapiens
cauauguagugacacugagucaucuguuuccugcuuccccacacucugccucuccugacaucu

SEQ ID NO: 2120 - RNA, 63 nt, Homo sapiens
cauauuagugauugaaguauuuugacuuuugagauugaauguaaaauauuuuaaauuugggau

SEQ ID NO: 2121 - RNA, 62 nt, Homo sapiens
cauauugguauaugacauaacaggaaacaguauuguaugauauauuuauaaaugcuauaaag

SEQ ID NO: 2122 - RNA, 62 nt, Homo sapiens
cauauuguggaauugacucaaaaaugagguacuucaguauuaaauuagauaucuucauagca

SEQ ID NO: 2123 - RNA, 63 nt, Homo sapiens
cauauuugguaaguuuuguacauauauuauguacacucagggaaccaauaccauaaucaugau

SEQ ID NO: 2124 - RNA, 63 nt, Homo sapiens
caucacaguauuguuaggagauuuaaaugaauuagugaauguaagauacuuuagaaagcaugu

SEQ ID NO: 2125 - RNA, 63 nt, Homo sapiens
caucaggacucagaccccaggccgagaucuugcccugaauguacccugccucugcuuucuccu

SEQ ID NO: 2126 - RNA, 64 nt, Homo sapiens
caucaggagaggucucguucgucuccagcucauaaaauguagcagcaucauccuugacagugau

SEQ ID NO: 2127 - RNA, 62 nt, Homo sapiens
caucagggcaucauagaauugagcauugaauuugcuacuguaggaguauuuuuaggagcaga

SEQ ID NO: 2128 - RNA, 63 nt, Homo sapiens
caucaggguucucuuagcaacucagagaaaaaugcuccccacagcgucccuggcgcagguggg

SEQ ID NO: 2129 - RNA, 61 nt, Homo sapiens
caucccccuuccaugagcccagaccucccuggguggugcuaggcucugagcugggggcuca

SEQ ID NO: 2130 - RNA, 62 nt, Homo sapiens
caucgcaaaaaggcgauuugagaaaugugggcuucaguauuaauugccauuuugcugacacc

SEQ ID NO: 2131 - RNA, 63 nt, Homo sapiens
caucguuaacggguaccauuaaauauucugagaggugaauguaaaauauaaaagguauagguu

SEQ ID NO: 2132 - RNA, 62 nt, Homo sapiens
caucuaaugucaaaauagaaccaacugguaaucacaguauuauuuagugugguuuccaugac

SEQ ID NO: 2133 - RNA, 63 nt, Homo sapiens
caucucccuuagggacuacccauagacaugaaagguccccacagagcaagagauaagucuuuc

SEQ ID NO: 2134 - RNA, 63 nt, Homo sapiens
caucugccuuucuuucccccagcccccacccgcuuugaauguagagacccgugggcacuuuuc

SEQ ID NO: 2135 - RNA, 63 nt, Homo sapiens
caucuugucgcuuuuaggaccucccacaaccugguuccccacacauccauaguucugccuccc

SEQ ID NO: 2136 - RNA, 62 nt, Homo sapiens
caucuuuucuuaagcacuauguuuguguuuuuaucaguauuauauucauugucuuuggaaua

SEQ ID NO: 2137 - RNA, 63 nt, Homo sapiens
caugacgcgccaggcacaguucugcaaguauauugugaauguauuguucuagugggauacaca

SEQ ID NO: 2138 - RNA, 62 nt, Homo sapiens
caugagcuuuucuggcauauguuaugcauguuggcaguauuaaguguauaccaaauaauaca

SEQ ID NO: 2139 - RNA, 64 nt, Homo sapiens
caugauagcaggaacuacgcguggaacaucugucuaauguagcauccuuacuuccugccucagu

SEQ ID NO: 2140 - RNA, 61 nt, Homo sapiens
caugauuuuuuuugaguagggagcauuaguaccuggugcuagagaauagaacccucaaaua

SEQ ID NO: 2141 - RNA, 64 nt, Homo sapiens
caugcagucaguaaaccugugagacugcuggaggaaauguagcagacagcauggaggcugggac

SEQ ID NO: 2142 - RNA, 62 nt, Homo sapiens
caugcaucuacagcaggcauggauuguuuaugucguaugauauccuuuauuaaguaaguuca

SEQ ID NO: 2143 - RNA, 62 nt, Homo sapiens
caugccucuguggggagucugccucccagacuggcuacuguauguaauguauuuauguaugu

SEQ ID NO: 2144 - RNA, 62 nt, Homo sapiens
caugggacaacagagcuccuucauuuuuggacaacuacuguaaucauuuuuuuuuuaggaaa

SEQ ID NO: 2145 - RNA, 63 nt, Homo sapiens
cauggugguauggcugaacaaggagcggcagacaacucagggagaaacucaggagugcaguac

SEQ ID NO: 2146 - RNA, 61 nt, Homo sapiens
cauguccaggaguggccguugcuacaagucaccuggugcuacgaccagggugagaauaaag

SEQ ID NO: 2147 - RNA, 62 nt, Homo sapiens
cauguguacauuuuuaaucuguuauaguuggcggcaguauuaaaauggugaguaaagagccc

SEQ ID NO: 2148 - RNA, 57 nt, Homo sapiens
cauuaaaccagugucuuagaacagcgacccucagggaugcugggagugguccuguac

SEQ ID NO: 2149 - RNA, 63 nt, Homo sapiens
cauuauauagcauaggauauuauuacuugaauguucucagggaggcagcaagucagaaggccu

SEQ ID NO: 2150 - RNA, 62 nt, Homo sapiens
cauucacaacagaaaacccaaaauauuaugcaaacuacuguaagcaagaaaaauaaaggaaa

SEQ ID NO: 2151 - RNA, 61 nt, Homo sapiens
cauuccuuaacccgcugccucagugguaauaaauggugcuagauauugcuacuauuuuaua

SEQ ID NO: 2152 - RNA, 62 nt, Homo sapiens
cauugaacuuuaaaaaacuuauuuauuuauuccacuacuguagcaauugacagauuaaaaaa

SEQ ID NO: 2153 - RNA, 63 nt, Homo sapiens
cauugaagagguugauuaaggccaaccaaguguagauguagcauuguuccacacauuuaaaac

SEQ ID NO: 2154 - RNA, 63 nt, Homo sapiens
cauugagcagcugaagcuaacucaugacucuguuuugaauguaaauauuuguaauuaagccug

SEQ ID NO: 2155 - RNA, 61 nt, Homo sapiens
cauuguccccaacuuuacuacugcugccgucaauggugcuacuauauaugaucaagauaac

SEQ ID NO: 2156 - RNA, 63 nt, Homo sapiens
cauuuauaguuuuucucuucucuucuauguugcaaugaauguaaaguauuugggauccagugc

SEQ ID NO: 2157 - RNA, 62 nt, Homo sapiens
cauuuaugacccaaucuguacuaauucuccaaaccaguauuauuucaauuauggcacuuggg

SEQ ID NO: 2158 - RNA, 63 nt, Homo sapiens
cauuucccagcccugggucaagggccugccuucgccucagggacucucuuccuuuggaugagg

SEQ ID NO: 2159 - RNA, 63 nt, Homo sapiens
cauuuuccuuauuguuaaaaacauguuagaagcaaugaauguauauaaaagccucaacuaguc

SEQ ID NO: 2160 - RNA, 62 nt, Homo sapiens
cauuuuguauaauggccagaacuuugucgugugacaguauuagcacugccucaguuaaaggu

SEQ ID NO: 2161 - RNA, 63 nt, Homo sapiens
cauuuuuuaaugugcucuguaccugucaaaaauuuugaauguacaccacaugcuauugucuga

SEQ ID NO: 2162 - RNA, 64 nt, Homo sapiens
cauuuuuuauuugugcaugaauugauuauugagaaaauguagcaguuugcauauuuaaaaauua

SEQ ID NO: 2163 - RNA, 62 nt, Homo sapiens
ccaaauuauuguggguguacuuuggcuuccuuuuguaugauagguccccaucaugaccaccu

SEQ ID NO: 2164 - RNA, 62 nt, Homo sapiens
ccaacacaaaacuguguuuacugaaagccgaaaacaguauuaaaaaaaguguguaaguaaag

SEQ ID NO: 2165 - RNA, 63 nt, Homo sapiens
ccaagucugagucccaguuacuugggaggaucacuugaauguaggaucacuugagucuaggag

SEQ ID NO: 2166 - RNA, 64 nt, Homo sapiens
ccaauaugcauuuauuagacaucuguuuaaaugguaauguagcauuuauuuugcuaaauugaaa

SEQ ID NO: 2167 - RNA, 63 nt, Homo sapiens
ccaaucccauuuuucaguucuccuaggaugcaccccucagggagccuggccagaguuccgagg

SEQ ID NO: 2168 - RNA, 64 nt, Homo sapiens
ccaaugcuaugguuuccauguggacauacagugccuauguagcaggcacuuagaguaaauggac

SEQ ID NO: 2169 - RNA, 61 nt, Homo sapiens
ccaauggggcuggugggcaugcuguccacuguguggugcuaggacugccaaugccaggccc

SEQ ID NO: 2170 - RNA, 63 nt, Homo sapiens
ccacacacucccagcucacccucaccccagccucuuccccacauuagggguuucuuggaagcu

SEQ ID NO: 2171 - RNA, 63 nt, Homo sapiens
ccacagcagugaugccagcugggcacgucaggaccuccccacacacccacacgaugccacagg

SEQ ID NO: 2172 - RNA, 63 nt, Homo sapiens
ccacagcucaggaaaaagaugaggcauaacgaccuugaauguaauuggaguaagugacaaaau

SEQ ID NO: 2173 - RNA, 63 nt, Homo sapiens
ccaccaaggacaggcagaagccggacaggggcccuuccccacaccggggagagcugcucggac

SEQ ID NO: 2174 - RNA, 62 nt, Homo sapiens
ccaccaugccuggccuuuggggggauuuuaauuacaguauuaauuauaguucuaggauuucc

SEQ ID NO: 2175 - RNA, 63 nt, Homo sapiens
ccacccaggcgccgccccugugcuugcuccccgagcucagggauugccgaguccacguaacug

SEQ ID NO: 2176 - RNA, 61 nt, Homo sapiens
ccacccucccacacagccggccacagggagaacuggugcuaaccagggugcuugcuuuggu

SEQ ID NO: 2177 - RNA, 61 nt, Homo sapiens
ccaccgagagccaggcagcuuugaguggcagcguggugcuagcagcuucagcggaacaggg

SEQ ID NO: 2178 - RNA, 62 nt, Homo sapiens
ccaccuccaggcugcaucccaccuucccucuuggcuacuguaauuguaaauagcgaccuuug

SEQ ID NO: 2179 - RNA, 63 nt, Homo sapiens
ccaccucgugucugcucauaggaugacgcuggagauccccacacuuacucuacccucuuggca

SEQ ID NO: 2180 - RNA, 62 nt, Homo sapiens
ccacugaagauaccccaaaggaugcaagugccuacaguauuaucaggaggagaacaugaaaa

SEQ ID NO: 2181 - RNA, 64 nt, Homo sapiens
ccacuuucuuuagcaaauggaggaaauuaagcaccgauguagcacuucccacugccuggagaga

SEQ ID NO: 2182 - RNA, 62 nt, Homo sapiens
ccagaaaauucacaccaggagagaaaucuuacaaguaugauauugucuuugucaauaccuca

SEQ ID NO: 2183 - RNA, 53 nt, Homo sapiens
ccagaaacuccaugaaugaaaaugacucagggaaguguuuguugccccucaug

SEQ ID NO: 2184 - RNA, 62 nt, Homo sapiens
ccagaaaugggcaguucucccagggagugagcagcuacuguaacuuuuuuaaauuaagacaa

SEQ ID NO: 2185 - RNA, 63 nt, Homo sapiens
ccagaacugcugcaccauugaaaucuuaacuucaauccccacaaccucacaucuuucuaacuu

SEQ ID NO: 2186 - RNA, 63 nt, Homo sapiens
ccagaaggccaaguccgcagaagcccugauguguccucagggagcagggaaggccugacuucu

SEQ ID NO: 2187 - RNA, 63 nt, Homo sapiens
ccagaaucccugauuguuaaugggcucugcccucauccccacagucuugggaucucagggcac

SEQ ID NO: 2188 - RNA, 63 nt, Homo sapiens
ccagccaacuaagcagaggauaaaccguuagcaaaugaauguaauaauuacucauuuccaaga

SEQ ID NO: 2189 - RNA, 63 nt, Homo sapiens
ccagccagaguuggccucagaaugaccugcucuggcucagggaucccugguggauggggaaaa

SEQ ID NO: 2190 - RNA, 63 nt, Homo sapiens
ccagcccgaacaccauugagggagcugggagacccuccccacagugccacccaugcagcugcu

SEQ ID NO: 2191 - RNA, 63 nt, Homo sapiens
ccagccucuagggaccccuccucccuuuuuccuuguccccacacuccuacaccuaacucaccu

SEQ ID NO: 2192 - RNA, 63 nt, Homo sapiens
ccaggacucacccucauaccaucugcugccccgcuuccccacagaacugcuuacuagcccugc

SEQ ID NO: 2193 - RNA, 63 nt, Homo sapiens
ccaggccucgggaccaacucuuuguauaaccuaccugaauguauuaaaaacuaauuuuggaag

SEQ ID NO: 2194 - RNA, 63 nt, Homo sapiens
ccaggccugucuggggugggcgcugccgcucaccacucagggaggaccugggccccuuggcuu

SEQ ID NO: 2195 - RNA, 63 nt, Homo sapiens
ccaggcgugguguugcaugucuguagucacagcuacucagggagguugaggcagcaggauugc

SEQ ID NO: 2196 - RNA, 63 nt, Homo sapiens
ccagggaggccaccagaggagcggcgccuccauucuccccacagcaagggcuggcugugcagg

SEQ ID NO: 2197 - RNA, 63 nt, Homo sapiens
ccaggggaccuggacggaggguccccacagcccgugccccacgccgccuggaggccagagggg

SEQ ID NO: 2198 - RNA, 63 nt, Homo sapiens
ccagggggcucugcuccaaguucccuagcgggccccucagggagaaauagccucacgugcaau

SEQ ID NO: 2199 - RNA, 63 nt, Homo sapiens
ccaggguauauacuugaaagaaaugaagacauauguccccacaagaacucgugcaugaauauc

SEQ ID NO: 2200 - RNA, 62 nt, Homo sapiens
ccaggguccuucccugccccacuuccccuuuucccaguauuacugaauagucccagcuggag

SEQ ID NO: 2201 - RNA, 61 nt, Homo sapiens
ccagguaaaugguaugaucaauaaaggacaggcuggugcuaacauaaaauccaauauugua

SEQ ID NO: 2202 - RNA, 63 nt, Homo sapiens
ccagguccucuuacauuugacauaagcaauuuaccuccccacauuuccaggaccucuaugaca

SEQ ID NO: 2203 - RNA, 61 nt, Homo sapiens
ccagguugggagggggaaggugagggcuucggguggugcuauaauguggcacuggaucuug

SEQ ID NO: 2204 - RNA, 62 nt, Homo sapiens
ccaguaauauacuuaaauaagccaauacuuagaucuacuguaaggcagaugcuaauuauaag

SEQ ID NO: 2205 - RNA, 63 nt, Homo sapiens
ccaguagcugagcuccaaggacucaggcagagggacucagggauggggacugccaggggcagu

SEQ ID NO: 2206 - RNA, 61 nt, Homo sapiens
ccagucaggcugcagaggcaccucaacauuccauggugcuagugggcccucucucugggcc

SEQ ID NO: 2207 - RNA, 63 nt, Homo sapiens
ccagucccauaaaccuggcccucuuuggggaaagauccccacagagcauccuccucucaucug

SEQ ID NO: 2208 - RNA, 61 nt, Homo sapiens
ccaguuacuaacuacggaaauagcauccucugcuggugcuaagugugauuaggaagaagcc

SEQ ID NO: 2209 - RNA, 62 nt, Homo sapiens
ccaguugacuuuuauucauuagauacagaaggugcaguauuacacaucaccagcugccuuug

SEQ ID NO: 2210 - RNA, 63 nt, Homo sapiens
ccauaagggcuggcggcuuccuccgacgccgccccuccccacagcuucucgacugcagugggg

SEQ ID NO: 2211 - RNA, 61 nt, Homo sapiens
ccauaggacgccgacaaaggcagcgcugcaugguggugcuacuucauguguuaugagagug

SEQ ID NO: 2212 - RNA, 63 nt, Homo sapiens
ccauaucuuagcucagagcacagaggagugccuuauccccacacuugacugggcuguggaggu

SEQ ID NO: 2213 - RNA, 63 nt, Homo sapiens
ccaucagcccggacagugggaacuaacuggugcauuccccacacuuaccuuccgguggguugc

SEQ ID NO: 2214 - RNA, 63 nt, Homo sapiens
ccaucccauuaaagaccgggcugguuagcguccagcucagggagaagggcgcuagugccuaac

SEQ ID NO: 2215 - RNA, 63 nt, Homo sapiens
ccauccucucccauaagcacccaugucuuugaauaugaauguauuuguaaaauaccacguuuc

SEQ ID NO: 2216 - RNA, 63 nt, Homo sapiens
ccaucuagggaaggcuggacuaggccuugcggcuccucagggacucagguggcccuacuggga

SEQ ID NO: 2217 - RNA, 63 nt, Homo sapiens
ccaugcaagcuguugaccagaugacuucucaucucuccccacaccaugaugguuuaaggugcc

SEQ ID NO: 2218 - RNA, 63 nt, Homo sapiens
ccauggauaccucugugauucacgcugagcccaaguccccacacuggaaaacugggaaauggc

SEQ ID NO: 2219 - RNA, 62 nt, Homo sapiens
ccaugguaccaaucaugaaucuuuguuucagguucaguauuauguaguuguucguugguuau

SEQ ID NO: 2220 - RNA, 62 nt, Homo sapiens
ccauguuagcucaugguguaagaugaugucuugucaguauuacuguuuugcuaagccgcuuc

SEQ ID NO: 2221 - RNA, 63 nt, Homo sapiens
ccauucuguuguacaacagauauucagcaugcuuucucagggacaugcucugugcuggggaca

SEQ ID NO: 2222 - RNA, 62 nt, Homo sapiens
ccauuucccaucucagcuucaagggaggugucagcaguauuaucuccacuuucaaucucccu

SEQ ID NO: 2223 - RNA, 62 nt, Homo sapiens
cccaaauuauucugaagguuuuuugaugauggagguaugauagguuuaucacacagccuaag

SEQ ID NO: 2224 - RNA, 63 nt, Homo sapiens
cccaacuggggcuccuggggguacaggaauccuuaugaauguauagaaugcauacugccuagg

SEQ ID NO: 2225 - RNA, 63 nt, Homo sapiens
cccacaaagcaagaccuguauuuauaagccgagggcucagggagccuaacugcgggacccguc

SEQ ID NO: 2226 - RNA, 63 nt, Homo sapiens
cccacagagugugcaucagucaccaccccaacaugcucagggaggcagaguucuuccauuagu

SEQ ID NO: 2227 - RNA, 63 nt, Homo sapiens
cccacaggcacggaggggcaucccucccugccggccucagggagcgaacguggaugaaaacca

SEQ ID NO: 2228 - RNA, 63 nt, Homo sapiens
cccacaucaccuccccaccacccggccggggugugcucagggaauguggacucgcucaaaugc

SEQ ID NO: 2229 - RNA, 63 nt, Homo sapiens
cccaccccuaccaauuguuuuacuuccucuuccugcucagggagcagaugggccucacugguu

SEQ ID NO: 2230 - RNA, 63 nt, Homo sapiens
cccacccugcacuggggggagggugggcagggauacucagggacagggcaucaugggggauuu

SEQ ID NO: 2231 - RNA, 63 nt, Homo sapiens
cccaccucaggccucacacuuucccaugaaaagggugaauguauauaaccugagcccucucca

SEQ ID NO: 2232 - RNA, 62 nt, Homo sapiens
cccaccucuccaggugucaaaggugaaccgaguccaguauuagcugaaugucauuucguaca

SEQ ID NO: 2233 - RNA, 63 nt, Homo sapiens
cccaccucuuaaggacugguuccucagaaagcacccucagggaaaaaggugaaaacauuacau

SEQ ID NO: 2234 - RNA, 62 nt, Homo sapiens
cccaccuuaauuagagaaacauuuauauugcuuacuacuguaggcuguacaucucuuuuccg

SEQ ID NO: 2235 - RNA, 63 nt, Homo sapiens
cccacugcucugaugggugguuuguccaaggaugcugaauguaaugccuggucaauguggaag

SEQ ID NO: 2236 - RNA, 62 nt, Homo sapiens
cccagaacucugugcccaggagccaugccuugagcaguauuagccguguguguaugcaugug

SEQ ID NO: 2237 - RNA, 63 nt, Homo sapiens
cccagagcaggaagcauucagagagcagcuuuaaacucagggacagagccaugcugggaagac

SEQ ID NO: 2238 - RNA, 62 nt, Homo sapiens
cccaggagcccaugaaguaauagcguaaaguaaaguaugauauggaaaugugaaguuugcaa

SEQ ID NO: 2239 - RNA, 63 nt, Homo sapiens
cccaggauccuccaugccacauggucacugcucuccucagggaccaggacaaggugcugcugc

SEQ ID NO: 2240 - RNA, 63 nt, Homo sapiens
cccaggccacaggcagggcagccucugagggccggcucagggagaguggccggagcuucuggc

SEQ ID NO: 2241 - RNA, 63 nt, Homo sapiens
cccagggcuccuggcuucagcaggaagugaacaggcucagggaacuggaggaagcgaagcauc

SEQ ID NO: 2242 - RNA, 63 nt, Homo sapiens
cccaggggugggaaguuuucauuugcaggggggucugaauguaacucaccauguggugugcaa

SEQ ID NO: 2243 - RNA, 62 nt, Homo sapiens
cccagggucuagccgcugcccuggguccugccugcaguauuacagaggucgucgaaaggugc

SEQ ID NO: 2244 - RNA, 63 nt, Homo sapiens
cccaguagcaauaaacauauaauauaggaggagucugaauguagagaugaaaaauacagaaug

SEQ ID NO: 2245 - RNA, 64 nt, Homo sapiens
cccaguguuuuugcaaagaaugaaaagggaccccauauguagcaaaaaucagggcugggggaga

SEQ ID NO: 2246 - RNA, 62 nt, Homo sapiens
cccaucccggcagacccuuaucguugguguuuuccaguauuacaagaucaacuucugacccu

SEQ ID NO: 2247 - RNA, 63 nt, Homo sapiens
cccauggcugggaggggccucugaacggaacaguguccccacagagcgaauaaagccaaggcu

SEQ ID NO: 2248 - RNA, 62 nt, Homo sapiens
cccaugucaggaugccauagugcuguggggagcacaguauuacccaguggguagggcuucug

SEQ ID NO: 2249 - RNA, 63 nt, Homo sapiens
ccccaaaagcagcuccaacagaauggccagagggccucagggagcugcaaaacucauccagga

SEQ ID NO: 2250 - RNA, 63 nt, Homo sapiens
ccccacagucaaagccuggggacccagacauccuguccccacagucagccuccugucccugcu

SEQ ID NO: 2251 - RNA, 62 nt, Homo sapiens
ccccagagagauaaaauacauguauaguguuuuucaguauuacacauugauuuaaaaagauu

SEQ ID NO: 2252 - RNA, 63 nt, Homo sapiens
cccccacagcaguaucagaaacuucugacaaucagugaauguacaacccagccgaggggacgg

SEQ ID NO: 2253 - RNA, 62 nt, Homo sapiens
cccccaccaccaggcuucuauuugggauucacaucaguauuaguaucguagcuacaccaagu

SEQ ID NO: 2254 - RNA, 63 nt, Homo sapiens
cccccacccugccuggugugcagcuaaccccucccuccccacagccagaggaggccacagacc

SEQ ID NO: 2255 - RNA, 63 nt, Homo sapiens
cccccacuuuuagacauaccccagagcccuguggcuccccacacccugccauaggggcagucc

SEQ ID NO: 2256 - RNA, 63 nt, Homo sapiens
cccccugccucuagcaccucuucugucccugucauuccccacacacguccuguucaccucgag

SEQ ID NO: 2257 - RNA, 62 nt, Homo sapiens
ccccuaaagaugcaacccuuaaagauacaguguucaguauuauugaaauaugggcaucugca

SEQ ID NO: 2258 - RNA, 63 nt, Homo sapiens
ccccucacugcaaaagcaucuccuuaaguagcaaccucagggacugggggcuacagucugccc

SEQ ID NO: 2259 - RNA, 63 nt, Homo sapiens
ccccucagccccagcccagacaaagaugucuuaaccucagggagugcagacaccuaaccccag

SEQ ID NO: 2260 - RNA, 63 nt, Homo sapiens
ccccucgcccgccgccuccccuccgguccccucuuuccccacacuucgcgacccuccucccgc

SEQ ID NO: 2261 - RNA, 63 nt, Homo sapiens
ccccucguccacccaccccuggcuggcagccucccuccccacacccgccccugugcucugcug

SEQ ID NO: 2262 - RNA, 61 nt, Homo sapiens
ccccugcaucuccaacaaguccaaggugacagcuggugcuaggggcgugggguuaauaaau

SEQ ID NO: 2263 - RNA, 62 nt, Homo sapiens
cccgcaaggcccucagagcagcgccugugggugucaguauuaccugagccuaggccaaagcu

SEQ ID NO: 2264 - RNA, 62 nt, Homo sapiens
cccuagugauuuuuggauaaggaucacuacugaacaguauuaggcaacuuuucauuuuugcu

SEQ ID NO: 2265 - RNA, 63 nt, Homo sapiens
cccuauguagcaacagugguuagaugaucuuugucugaauguaauuaaacuuugaauaguuuu

SEQ ID NO: 2266 - RNA, 63 nt, Homo sapiens
cccucagacagcccccugccccgcaggccugccuucucagggacuucugcggggccugaggca

SEQ ID NO: 2267 - RNA, 62 nt, Homo sapiens
cccuccuugaacuaggauuguagucccaaagaggcuacuguaaggcaaucauggugcucaga

SEQ ID NO: 2268 - RNA, 63 nt, Homo sapiens
cccucgaccaccgccccucuccccauccguccccccucagggaccaagaaguccaagaggggc

SEQ ID NO: 2269 - RNA, 63 nt, Homo sapiens
cccugcagccugagccuucuuacugugaauuauaacucagggacuguggcucguggcggugcu

SEQ ID NO: 2270 - RNA, 61 nt, Homo sapiens
cccugccccacuggggauaggagccugugucccuggugcuaagcacucucuucacuugggc

SEQ ID NO: 2271 - RNA, 63 nt, Homo sapiens
cccugccccagccuagcugagugugcuggcaaaguuccccacaggacucagccuucucgucuu

SEQ ID NO: 2272 - RNA, 63 nt, Homo sapiens
cccugggcaggaccagaggcccacauggaugccacuccccacacagcccccaggccugcccag

SEQ ID NO: 2273 - RNA, 63 nt, Homo sapiens
cccuggggggggccaggcuccagagagggggcaccuccccacacaccccccccccaccgaggc

SEQ ID NO: 2274 - RNA, 63 nt, Homo sapiens
cccugguggucuggcccuuucuuuuuccuccuauccucagggaccugugcugcucugcccuca

SEQ ID NO: 2275 - RNA, 63 nt, Homo sapiens
cccugugacaggggaaagggcucucuuacaccgcacucagggagaccacuucucaggaugggg

SEQ ID NO: 2276 - RNA, 63 nt, Homo sapiens
cccugugagaagccguggcccccuucucccgugcucucagggagggugcaccaggccugcccc

SEQ ID NO: 2277 - RNA, 63 nt, Homo sapiens
cccuguuuucucuccuaacaugcugagauucugcauccccacagccuaaacugagccaguggc

SEQ ID NO: 2278 - RNA, 63 nt, Homo sapiens
cccuuaguaccaaauacacucaauugccuuuuuaaugaauguacuugucuuggauagguugcu

SEQ ID NO: 2279 - RNA, 63 nt, Homo sapiens
cccuucacccaaccucucccaccuccaccccacaaugaauguauuuauugugagaauggcuac

SEQ ID NO: 2280 - RNA, 63 nt, Homo sapiens
cccuugaaaaauccaauugguuucuguuauagcaguccccacaacaucaaagaaccaccacaa

SEQ ID NO: 2281 - RNA, 62 nt, Homo sapiens
cccuuuguacuucaaaauauguuuuuguguccaucaguauuaacuauugguauacuacuggu

SEQ ID NO: 2282 - RNA, 54 nt, Homo sapiens
ccgagagaagaagcagugacccucucuccccacacccucaccugcacccuagga

SEQ ID NO: 2283 - RNA, 62 nt, Homo sapiens
ccgcauuuugcugcauaugccuuuaaaaucaaugcaguauuaccauuaaaacaugggacucu

SEQ ID NO: 2284 - RNA, 63 nt, Homo sapiens
ccgcccccuccggggcugagccugggucugaagacugaauguaacaggggccgcuggcacucc

SEQ ID NO: 2285 - RNA, 63 nt, Homo sapiens
ccgcccuugccgaaccaggagcugcucacuaccuccucagggauggccguuggccacgucuuc

SEQ ID NO: 2286 - RNA, 62 nt, Homo sapiens
ccggaggucgaggcuacagugagccaagagugcacuacuguacuccagccagggcaagagag

SEQ ID NO: 2287 - RNA, 62 nt, Homo sapiens
ccggcaucaaggcacaggggaccaguggggaacacuacuguaguuagaucucccgccccgcc

SEQ ID NO: 2288 - RNA, 63 nt, Homo sapiens
ccggccgccggggcacauagggguuuuaucgggcgugaauguaaauaaauuauauauauauau

SEQ ID NO: 2289 - RNA, 63 nt, Homo sapiens
ccgucucaaaaaaaaaaaaaaaaaaaaaaaaagagugaauguaauagucuugcagaaaaugaa

SEQ ID NO: 2290 - RNA, 63 nt, Homo sapiens
ccgucucuuggaccuaagauggaauguguccccagcucagggauugccugaaccaagaggcca

SEQ ID NO: 2291 - RNA, 63 nt, Homo sapiens
ccgucugucaugucacgccacugcacagguccuuguccccacacgacggggaguacuugcguc

SEQ ID NO: 2292 - RNA, 63 nt, Homo sapiens
ccguuaccaauacaacacugaugugguguuugauucucagggaaaacuguuggcacgcuacca

SEQ ID NO: 2293 - RNA, 63 nt, Homo sapiens
ccguuguuuaggguagaauaggcuguguauuuacaugaauguauaauaucuaugucagcagua

SEQ ID NO: 2294 - RNA, 61 nt, Homo sapiens
ccuaaaugucagugcagcaguguuaaccagucauggugcuagauuguuuacuugguuuucu

SEQ ID NO: 2295 - RNA, 62 nt, Homo sapiens
ccuaacugauuaugcgaaauacccaagauucaugcuacuguaccacagauuuguuuucacag

SEQ ID NO: 2296 - RNA, 63 nt, Homo sapiens
ccuacugugugcaaaguguuucauguauaucucauugaauguauacagccacccuguuguggu

SEQ ID NO: 2297 - RNA, 62 nt, Homo sapiens
ccuagaaaaaauggauucugauugguucugguugcaguauuacaaauuccaaauaaagcuuu

SEQ ID NO: 2298 - RNA, 64 nt, Homo sapiens
ccuauaccauaaaguguaguuaccauacagauuaauauguagcaaaaauguaugcuugauauuu

SEQ ID NO: 2299 - RNA, 63 nt, Homo sapiens
ccuauaccuuaccagagcauggaagagcccagaucugaauguaaaacgucucuguucugccag

SEQ ID NO: 2300 - RNA, 63 nt, Homo sapiens
ccuauacugaauuuuugguaccacaguuucccucuugaauguacuaaaacacaaaaaacugac

SEQ ID NO: 2301 - RNA, 63 nt, Homo sapiens
ccuauggccgcucuccagacccuccuccuuucuucuccccacauccgcaccugcuguucccac

SEQ ID NO: 2302 - RNA, 63 nt, Homo sapiens
ccucaacaauuggaaaauagcaaggaaaauuacuuugaauguauccagaaaaauacugaagug

SEQ ID NO: 2303 - RNA, 63 nt, Homo sapiens
ccucacagggguguugugaggaucaaaggaacagaugaauguaugagcacuuucagacaugua

SEQ ID NO: 2304 - RNA, 61 nt, Homo sapiens
ccucacuccuccgucgcugcccuucacaccuuuuggugcuaccccuccccagaguuaagca

SEQ ID NO: 2305 - RNA, 63 nt, Homo sapiens
ccucagauggugguauuugcuaacaucauauccaacucagggaagcggacugagugcugggau

SEQ ID NO: 2306 - RNA, 63 nt, Homo sapiens
ccucaggagucugaacacugggcuuaugccuuacucucagggacaagcagcccccauugcugc

SEQ ID NO: 2307 - RNA, 63 nt, Homo sapiens
ccucauuuuucuauauauuuauuucacgacagaguugaauguauggccuucaacaugaugcac

SEQ ID NO: 2308 - RNA, 62 nt, Homo sapiens
ccuccaagaaaauggugacucacucucaagucagcuacuguagagaggguucuaauugguuc

SEQ ID NO: 2309 - RNA, 63 nt, Homo sapiens
ccuccagacguagccauuuccugacaucaagauguugaauguaaucuggucugagcugggccu

SEQ ID NO: 2310 - RNA, 55 nt, Homo sapiens
ccuccauccuugggccugaggagccccuccccacaacucaguguccuucaaauau

SEQ ID NO: 2311 - RNA, 63 nt, Homo sapiens
ccuccaugauuugggaaccagcuuaggcaaaagaguccccacaagaugaaaauaaagauccua

SEQ ID NO: 2312 - RNA, 63 nt, Homo sapiens
ccucccuccggccauacugccuuugcaguuggacucucagggauucugggcuugggguguggg

SEQ ID NO: 2313 - RNA, 63 nt, Homo sapiens
ccucccucuccauaucuccuuccccuacaccucccuccccacaccucccuacuccccugggca

SEQ ID NO: 2314 - RNA, 62 nt, Homo sapiens
ccuccucuaguuaacuuagcuuuauguagaauuucuacuguauuuaauuucuauugaagccc

SEQ ID NO: 2315 - RNA, 63 nt, Homo sapiens
ccuccugauggucucauccuuauccuggucucccacucagggaaccuccugauuauucugcuc

SEQ ID NO: 2316 - RNA, 63 nt, Homo sapiens
ccuccugcauuugccuggcccugaucucgccuguccucagggauccagacuuccucugcuggu

SEQ ID NO: 2317 - RNA, 63 nt, Homo sapiens
ccuccugcccccucucccacuuuucccuuccucuuuccccacagccccccagccccucagccc

SEQ ID NO: 2318 - RNA, 61 nt, Homo sapiens
ccucgugaaauagugugcaguggaggucucuuguggugcuagauguguguuuagagcuaaa

SEQ ID NO: 2319 - RNA, 64 nt, Homo sapiens
ccucguguaugacagguagcuagggagcucuuggagauguagcaguugggauugugggagauua

SEQ ID NO: 2320 - RNA, 63 nt, Homo sapiens
ccucguucaguugcacuucaguauuuucacggauaugaauguaaaauauauaaauauauaaac

SEQ ID NO: 2321 - RNA, 62 nt, Homo sapiens
ccucuaccaauccaucuucagcugacugaauguuguaugauagcccuucuccaaagcagagg

SEQ ID NO: 2322 - RNA, 61 nt, Homo sapiens
ccucuccaugcugcaaucacuguccugggcuuauggugcuauggacuagggguccuuugug

SEQ ID NO: 2323 - RNA, 62 nt, Homo sapiens
ccucucugauucacuuaguaaucuauccucuuuucaguauuacaugugcuuaaucucagaug

SEQ ID NO: 2324 - RNA, 62 nt, Homo sapiens
ccucuggucuccugguucaacaacaggcuuauauguaugauacauguaauuuaaaccuucag

SEQ ID NO: 2325 - RNA, 63 nt, Homo sapiens
ccucugugcccacagcagcccuuggguauaacuguuccccacagaggcugaaccccaagggca

SEQ ID NO: 2326 - RNA, 62 nt, Homo sapiens
ccugaaaaagcagguauuuucucagaccccagagcaguauuaaugaugcagagguuggagga

SEQ ID NO: 2327 - RNA, 62 nt, Homo sapiens
ccugaacaaugaauucccauuaaugagcagucuucaguauuaaaaccacugucuugucaccu

SEQ ID NO: 2328 - RNA, 61 nt, Homo sapiens
ccugaagcgcucucgagcuguucuguaaauaccuggugcuaacaucccaugccgcucccuc

SEQ ID NO: 2329 - RNA, 62 nt, Homo sapiens
ccugaccuccuggacuguaggacuauauaaaguacuacuguagaacugcaauuuccauucuu

SEQ ID NO: 2330 - RNA, 64 nt, Homo sapiens
ccugacucacucggcucuguuaguguaaccuuuuaaauguagcaacacaaacccuuucccucuu

SEQ ID NO: 2331 - RNA, 63 nt, Homo sapiens
ccugacuugccuuauuuauuuguucgacgcgucucugaauguauccgccucgguucccaccac

SEQ ID NO: 2332 - RNA, 63 nt, Homo sapiens
ccugaguccugggaucagacaccccuucacguguauccccacacaaaugcaagcucaccaagg

SEQ ID NO: 2333 - RNA, 63 nt, Homo sapiens
ccugagugaaaggccgccugccggggacucagacacucagggaacaaaauggucagccagagc

SEQ ID NO: 2334 - RNA, 63 nt, Homo sapiens
ccugauguguccuuuuuuuuugcauuuguuaauucugaauguauuuuuaacagaaugauuuuu

SEQ ID NO: 2335 - RNA, 63 nt, Homo sapiens
ccugcaaaccaacaggugcauggugaguguggcaguccccacagcuccacaaugggcuccccc

SEQ ID NO: 2336 - RNA, 63 nt, Homo sapiens
ccugcggcucagccuugcacacccacugccccgugugaauguagcuuccaccucauggauugc

SEQ ID NO: 2337 - RNA, 63 nt, Homo sapiens
ccugcuaguucccacuccccugugaccacuggggccucagggaagauaaagaaagcugggccu

SEQ ID NO: 2338 - RNA, 63 nt, Homo sapiens
ccugcugucugucaaaagucucacagagagagggccucagggagcugcugaggggugcugagc

SEQ ID NO: 2339 - RNA, 63 nt, Homo sapiens
ccuggacugccggaaucccagcauuagcuuccugcugaauguaguauuuggcauucucugaau

SEQ ID NO: 2340 - RNA, 63 nt, Homo sapiens
ccuggagacccccagccaaacgggucagugucucauccccacauaacacaaaaagcagccugg

SEQ ID NO: 2341 - RNA, 61 nt, Homo sapiens
ccuggaguguucauccuuucagugccauuauucuggugcuaagugcugaagaacauuuuca

SEQ ID NO: 2342 - RNA, 63 nt, Homo sapiens
ccuggcucuucccugggccucaccagggacacucuugaauguauggccucaggcgcucccuag

SEQ ID NO: 2343 - RNA, 63 nt, Homo sapiens
ccugggaauuugcuggaaaugcaggcucaagccccuccccacaccuggugaaugagagagccc

SEQ ID NO: 2344 - RNA, 61 nt, Homo sapiens
ccugggcagaugcugcagcccgcccccuucucauggugcuacuuccucugucagcuacaga

SEQ ID NO: 2345 - RNA, 63 nt, Homo sapiens
ccugggccucucucccgcccagcauccucccugaguccccacacagggccucacucugcaccc

SEQ ID NO: 2346 - RNA, 63 nt, Homo sapiens
ccuggggcccuuucccuucuggaggaagcacaagccucagggaaggggaagcaggaugcggag

SEQ ID NO: 2347 - RNA, 63 nt, Homo sapiens
ccugggugugcaccugcuccgggggguggaggugcuccccacaguccgggccaggacagccuc

SEQ ID NO: 2348 - RNA, 63 nt, Homo sapiens
ccuggucccaguagguaucaggucuuucugugcagcucagggagacccuaaguuaaggggcag

SEQ ID NO: 2349 - RNA, 63 nt, Homo sapiens
ccuguccagcacagcuucuggcacaggaugcuuggugaauguacccuuucuuucccucccugc

SEQ ID NO: 2350 - RNA, 63 nt, Homo sapiens
ccuguucucggcagcuucugucgcuggcccugggguccccacagcugcagcucuccugugagg

SEQ ID NO: 2351 - RNA, 64 nt, Homo sapiens
ccuguuguaagaauuuucccaccucuucugacaugaauguagcauaaguuagcaaucgguucuu

SEQ ID NO: 2352 - RNA, 63 nt, Homo sapiens
ccuuaaaagguaagcuccaugagauaagagaugcucucagggaaaagacauuggcuuuagaaa

SEQ ID NO: 2353 - RNA, 63 nt, Homo sapiens
ccuuacuaguuaaagaacagacauuaauuuucaguugaauguauuuuugcaggcaucauauug

SEQ ID NO: 2354 - RNA, 62 nt, Homo sapiens
ccuuacuuacccaucaguccucuaguccuccaaacuacuguagcagauacuuugccaccuuu

SEQ ID NO: 2355 - RNA, 63 nt, Homo sapiens
ccuuccacacagggugcaugugaggaugaaaggagugaauguauaaagacaccuuucccgaua

SEQ ID NO: 2356 - RNA, 63 nt, Homo sapiens
ccuuccugccauugcugcaccaggacugcaaggaguccccacaccuuggcagcucaggguccc

SEQ ID NO: 2357 - RNA, 63 nt, Homo sapiens
ccuucuauuccugagggcucagagcugaccaugcaugaauguauggcaguguccacuuuucug

SEQ ID NO: 2358 - RNA, 63 nt, Homo sapiens
ccuucuguuagaagacuaaacauacguacccaccaugaauguaugauacaugaaauuuggccu

SEQ ID NO: 2359 - RNA, 63 nt, Homo sapiens
ccuucuugcuggggaggggacgaguucuacccaccuccccacacuggcacucagccagcugcc

SEQ ID NO: 2360 - RNA, 62 nt, Homo sapiens
ccuugcaaagguaaucucucauuuuaaaauuggacaguauuaaugaaggggaaauauacaau

SEQ ID NO: 2361 - RNA, 62 nt, Homo sapiens
ccuugccaguuuuccgaagucucugauuaguugacaguauuaacacuaaauugcaguuuaca

SEQ ID NO: 2362 - RNA, 63 nt, Homo sapiens
ccuuggccugaguuuagacauacaugaaagaugacugaauguagcuauccugauuugucauga

SEQ ID NO: 2363 - RNA, 63 nt, Homo sapiens
ccuugguauuuacccaguggagcugaaaauguauguccccacagaaaaacaggcacguggacg

SEQ ID NO: 2364 - RNA, 63 nt, Homo sapiens
ccuugugagaagccguggcccccuucuccagugcucucagggagggugcaccaggccugcccc

SEQ ID NO: 2365 - RNA, 61 nt, Homo sapiens
ccuugugcagcggaccacuugcccaguuugcuguggugcuagccuuccccaucauccaccg

SEQ ID NO: 2366 - RNA, 62 nt, Homo sapiens
ccuuguuucucuuuuauuuuuuauuuuuucgcaucaguauuaauguuuuugcauacuuugca

SEQ ID NO: 2367 - RNA, 64 nt, Homo sapiens
ccuuuaucauuccugagacaguuugcuaauuuaaaaauguagcauuccauuuguauuuauuucu

SEQ ID NO: 2368 - RNA, 61 nt, Homo sapiens
ccuuuauuuguuuagacgugcuucaucccgaaguggugcuauggucuguuaaacagggcug

SEQ ID NO: 2369 - RNA, 63 nt, Homo sapiens
ccuuucccuuuguuaguguccuggguucccauggacucagggauuuguuggcuaagguuucuc

SEQ ID NO: 2370 - RNA, 63 nt, Homo sapiens
ccuuucuaggcuuggagauggcuuugguugguccgugaauguaguuaugagagugcugccauu

SEQ ID NO: 2371 - RNA, 63 nt, Homo sapiens
ccuuucugggcugccucagucccucaaaggggagcuccccacaugggugggauuauuguugag

SEQ ID NO: 2372 - RNA, 63 nt, Homo sapiens
ccuuugaaaggcuugguugcucccaggcugcuguucucagggaccuuaaaagggaccugguua

SEQ ID NO: 2373 - RNA, 62 nt, Homo sapiens
ccuuuuguauucaaaugaaguuauuuuucuugaacuacuguaauauguagauuuuuuguauu

SEQ ID NO: 2374 - RNA, 63 nt, Homo sapiens
cgaauucauacuggagagaaacccuaugaauguaaagaauguggaaaacccuucaguuuccuu

SEQ ID NO: 2375 - RNA, 63 nt, Homo sapiens
cgaggauguaguuguugcugccgucgucccaccaccucagggaccagagggcuagguuggcac

SEQ ID NO: 2376 - RNA, 61 nt, Homo sapiens
cgagggccgaaacuccugucugcuaucgagcccuggugcuauguggccccggagccacagc

SEQ ID NO: 2377 - RNA, 62 nt, Homo sapiens
cgagguuaaagaagcugcauguuaagugccauuacuacuguacacggaccaucgccucuguc

SEQ ID NO: 2378 - RNA, 63 nt, Homo sapiens
cgagucauuucguucccugauuauuuauccuugucugaauguauuuauguguauauuuguaga

SEQ ID NO: 2379 - RNA, 63 nt, Homo sapiens
cgcaacaaggacuccucgcugcugaccaggcucuaugaauguacauggaaugaccaggcucua

SEQ ID NO: 2380 - RNA, 63 nt, Homo sapiens
cgcauccccugcuugccacuaugcgcaccaagguuuccccacauccuucccagcacccuuagg

SEQ ID NO: 2381 - RNA, 62 nt, Homo sapiens
cgcaugcaggcauguaaauauuugucuggagucacaguauuaaugaaugagaucuuaagcau

SEQ ID NO: 2382 - RNA, 63 nt, Homo sapiens
cgccagaggccugaagcugagcguguacguuaaugugaauguauauagucuuugcagaggucc

SEQ ID NO: 2383 - RNA, 63 nt, Homo sapiens
cgcccccuagaggaacuuuccuuccuuuccagcauuccccacagcacugccggccaggggaga

SEQ ID NO: 2384 - RNA, 63 nt, Homo sapiens
cgccuccagcugaccugcccuguccucuccagcuguccccacaagcagagcccugaggggugg

SEQ ID NO: 2385 - RNA, 62 nt, Homo sapiens
cgccucgcugugccagacacaguaggcgcucaaucaguauuaguucccaccauuccccuuuu

SEQ ID NO: 2386 - RNA, 63 nt, Homo sapiens
cgcuggaaggagagaaggaagcgggaagugugcuucucagggaggaaaccggcuugccagcaa

SEQ ID NO: 2387 - RNA, 61 nt, Homo sapiens
cgcuucggagcgguccucaguggcgccaccugcuggugcuaauagggacagccacaggccu

SEQ ID NO: 2388 - RNA, 61 nt, Homo sapiens
cggaaaggaaucuaauuccaagagucuaggaaauggugcuauugugaguucguucugacuc

SEQ ID NO: 2389 - RNA, 63 nt, Homo sapiens
cggaagcagguguguccagagucagcugagggcucuccccacaccacccagcaggcgcuggug

SEQ ID NO: 2390 - RNA, 63 nt, Homo sapiens
cggcaccucagugggugggcagggcuuggucccccuccccacagcaagggaaggcagcuggcu

SEQ ID NO: 2391 - RNA, 63 nt, Homo sapiens
cggcacuggggaagucaagaauggggccuggggcucucagggagaacugcuuccccuggcaga

SEQ ID NO: 2392 - RNA, 64 nt, Homo sapiens
cggcagcucuuccugccacugaaugcguucugcagcauguagcaugcccaccuagcucccuggc

SEQ ID NO: 2393 - RNA, 63 nt, Homo sapiens
cggcauggaaggguucacacuugggagaaacucuaugaauguaagcaguaugggaaagccuuc

SEQ ID NO: 2394 - RNA, 63 nt, Homo sapiens
cggcccccugcuccacacacugcugcaucuugggucucagggacccagacagauggacuuaca

SEQ ID NO: 2395 - RNA, 63 nt, Homo sapiens
cggcguggcugugcuuccuggggaaaugaacccccuccccacagacaccacccuggguggauc

SEQ ID NO: 2396 - RNA, 63 nt, Homo sapiens
cgggaccacauggcuugguggcuuggacaaacaagcucagggaggaaaugaggaggcggcggc

SEQ ID NO: 2397 - RNA, 63 nt, Homo sapiens
cgggacuccagcuugccacgugcccucuccccucuugaauguacucuggucuugcagugugcu

SEQ ID NO: 2398 - RNA, 62 nt, Homo sapiens
cgggagaccccaacucccccugaacaauccuuuucaguauuauauuuuuauuauuauuaugu

SEQ ID NO: 2399 - RNA, 62 nt, Homo sapiens
cgguugugguuggcacccucgggugguagcucuucuacuguaaugagacaagccuuucuucu

SEQ ID NO: 2400 - RNA, 62 nt, Homo sapiens
cguaaauuauaguauuuggauggagcaaagucagcaguauuaaugguugaauauuaaugguu

SEQ ID NO: 2401 - RNA, 63 nt, Homo sapiens
cguagccucuaucucguauuuuuuucuauuucuccuccccacaccaucaaugggacuauucug

SEQ ID NO: 2402 - RNA, 63 nt, Homo sapiens
cgucacuguccuguggauguuaaaccucguuuuuuuccccacacgauauuaaaacuuaaagca

SEQ ID NO: 2403 - RNA, 63 nt, Homo sapiens
cgucagaaaaugggcauagaauguacccaugcaauugaauguaucucauucuccacuggcaua

SEQ ID NO: 2404 - RNA, 63 nt, Homo sapiens
cgucagcaugugcaaguuccaggggguacagauagugaauguauugaauaugcuuuccuuccu

SEQ ID NO: 2405 - RNA, 62 nt, Homo sapiens
cgucuuuggauuguccaguuugccucagcccuuaguaugauacuccuaccccaauugccaug

SEQ ID NO: 2406 - RNA, 63 nt, Homo sapiens
cgugauuccuuaaguacauuuuuccaaugaauaaucucagggaccccucauaugggcuagucc

SEQ ID NO: 2407 - RNA, 63 nt, Homo sapiens
cguggcagacugaaagcccuggggcuggggcucggcucagggaauaaaaggagcgucccugcu

SEQ ID NO: 2408 - RNA, 63 nt, Homo sapiens
cguggcgacuuagaguuggcggauauucggaacugugaauguacauagcguugaguuaaaccc

SEQ ID NO: 2409 - RNA, 64 nt, Homo sapiens
cguggcgucugcuucccauccugggaguguguauauauguagcauaucaugggggacugggaag

SEQ ID NO: 2410 - RNA, 62 nt, Homo sapiens
cgugguugucugcuuuccuaaggacucccauuuccaguauuaaagagagaaucaucaucaag

SEQ ID NO: 2411 - RNA, 63 nt, Homo sapiens
cgugugccaggacagggcgaggcuccugccauagguccccacacacgaugucauaaaagcccc

SEQ ID NO: 2412 - RNA, 62 nt, Homo sapiens
cguuacuguguccauuauuggaauggaauuaucacuacuguaucaugaguggguauuuugau

SEQ ID NO: 2413 - RNA, 62 nt, Homo sapiens
cguuggaacgugagccucggauuuccuggccccucuacuguaaaugugccuuagccuaagcc

SEQ ID NO: 2414 - RNA, 64 nt, Homo sapiens
cguuggaagggcgcugggccucggcugggaccguucauguagcagcaaccggcggcggcugccg

SEQ ID NO: 2415 - RNA, 62 nt, Homo sapiens
cguuucuagaggcgucacuguauguaguucauggcuacuguacugacagcgagagcaugucc

SEQ ID NO: 2416 - RNA, 63 nt, Homo sapiens
cuaaaaucugagguuuugcccagugugacaucaaacucagggaagaggaagcuaaagugacga

SEQ ID NO: 2417 - RNA, 63 nt, Homo sapiens
cuaaagggacucugcggaaccuuucacaccucuuucucagggacggggcaggugugugugugg

SEQ ID NO: 2418 - RNA, 63 nt, Homo sapiens
cuaaaugauuuuuggcccauacccagcaacugugaugaauguauaaugaaauaacaucuugaa

SEQ ID NO: 2419 - RNA, 64 nt, Homo sapiens
cuaaccuagagcagguuuccauagugagaaaauucaauguagcagacuacugagaaacuacugu

SEQ ID NO: 2420 - RNA, 64 nt, Homo sapiens
cuaaccucuccagcugugagccucuuagacuacugcauguagcaaauguucagcagcucaggcc

SEQ ID NO: 2421 - RNA, 63 nt, Homo sapiens
cuaacuagcuuauuaaaauuuacaaaaugucuuuuugaauguaucaaggauauauuuaguuug

SEQ ID NO: 2422 - RNA, 63 nt, Homo sapiens
cuaacuccucaugucuagucaugcuggcagggcuuuccccacauccaugcuuuugaaauuagu

SEQ ID NO: 2423 - RNA, 61 nt, Homo sapiens
cuaagaaguguguucaugcaacagccauagagauggugcuauugaaaggcaaucugcccau

SEQ ID NO: 2424 - RNA, 62 nt, Homo sapiens
cuaagaucguugaagagcaauagaaccuuuaagacaguauuaaaggugugaaacaauggccc

SEQ ID NO: 2425 - RNA, 64 nt, Homo sapiens
cuacaauauuuaacuaaggcccaaccgauuuccauaauguagcaguuaccguguucaccucaca

SEQ ID NO: 2426 - RNA, 63 nt, Homo sapiens
cuacccaggaguccccuccauguacacacacacaacucagggaaggagguccugggacuccaa

SEQ ID NO: 2427 - RNA, 63 nt, Homo sapiens
cuaccccuuggccccuccuggucugugcaaacucccucagggagccccccugcccuguagcuc

SEQ ID NO: 2428 - RNA, 62 nt, Homo sapiens
cuaccuacugcagcugcugcuuugcgggggggcccuacuguacugaggggaaacccacaagu

SEQ ID NO: 2429 - RNA, 59 nt, Homo sapiens
cuaccuuggccuugaguagccaggggccugguccccacagcccacaggauggaccaaag

SEQ ID NO: 2430 - RNA, 61 nt, Homo sapiens
cuacucuuugcaccugacuuuuccuaguuguccuggugcuaacacaggagcuacaccuuga

SEQ ID NO: 2431 - RNA, 62 nt, Homo sapiens
cuacuggaguuacuaagaaucaccuaaaaaugugcuacuguaccuugcucauuuugcagauu

SEQ ID NO: 2432 - RNA, 63 nt, Homo sapiens
cuacuuauccagguuugcaaauguacauguucauuugaauguaaaucaccauuucuuggaacc

SEQ ID NO: 2433 - RNA, 63 nt, Homo sapiens
cuagaagugcgcaugaaggaugcuucaugcccuguuccccacacagagaagagaugaagaggg

SEQ ID NO: 2434 - RNA, 62 nt, Homo sapiens
cuagacugagaaauucauguuuacuuuucuagguguaugauacuuuguaaaguugauacuuu

SEQ ID NO: 2435 - RNA, 63 nt, Homo sapiens
cuagaucugccucuguuuugcuggucaaaaccucuuccccacaagccagauuguuucugagga

SEQ ID NO: 2436 - RNA, 63 nt, Homo sapiens
cuagcauauguauguucagugggcuagccuugguccucagggacagugugugacucuaguggu

SEQ ID NO: 2437 - RNA, 62 nt, Homo sapiens
cuagcauuucuguucugugcugugcuaagcuauacuacuguauguucuuucaguaaaaaaau

SEQ ID NO: 2438 - RNA, 62 nt, Homo sapiens
cuagcuguaaauauaaauuuugucccuuccauuucuacuguauaaacaaauuagcaaucauu

SEQ ID NO: 2439 - RNA, 61 nt, Homo sapiens
cuauaagaaaagugaaaguaacuguuuucuucuuggugcuaugacagugugagacucaggu

SEQ ID NO: 2440 - RNA, 63 nt, Homo sapiens
cuaugguuucuguagaucaucgucaucuuguauauuccccacaaagccguucgcagcuuccgg

SEQ ID NO: 2441 - RNA, 61 nt, Homo sapiens
cuauuaaugucucacuuuacuuucaaguaauauuggugcuauuuaacauuuuacaguaaau

SEQ ID NO: 2442 - RNA, 63 nt, Homo sapiens
cuauuagccagucuuuacagcugagcacauucuggcucagggagguuaagugacuugcccagu

SEQ ID NO: 2443 - RNA, 63 nt, Homo sapiens
cuauuauucccaucuuacagauaaaacaacugaggcucagggagauucugugacuuaccuaag

SEQ ID NO: 2444 - RNA, 63 nt, Homo sapiens
cuauuguagguuuuuuggagagauucauagggaagugaauguaaccaggaauaaaggcucuca

SEQ ID NO: 2445 - RNA, 63 nt, Homo sapiens
cuauuucugugcccuaguccuagacacacauuagacucagggaguuuugucugaagaccaggu

SEQ ID NO: 2446 - RNA, 63 nt, Homo sapiens
cucaaagucuccaguggaagcucauggacaagguucucagggaaguuuuggaguuugcaacca

SEQ ID NO: 2447 - RNA, 63 nt, Homo sapiens
cucaaguccagcauggauggggaaaugucucuggauccccacagcuguguacuuguuugcauu

SEQ ID NO: 2448 - RNA, 62 nt, Homo sapiens
cucaaguguuuccuagacagagaggcaccugggucaguauuagucuauuuaucagaggugua

SEQ ID NO: 2449 - RNA, 62 nt, Homo sapiens
cucaauggagguuugcaaagacugaguguucaaacuacuguacauuuuuuuucaagugcuaa

SEQ ID NO: 2450 - RNA, 63 nt, Homo sapiens
cucaauucagcucauguuggucauuucagaucaucugaauguaaaggguccucucugucucug

SEQ ID NO: 2451 - RNA, 64 nt, Homo sapiens
cucacaauaccagccacgcugccucucggccuaagcauguagcaaaugcucucacugcccuacg

SEQ ID NO: 2452 - RNA, 64 nt, Homo sapiens
cucacauuuuguuuugaaugggcaucuccugaggaaauguagcaugacauugguacuaacugca

SEQ ID NO: 2453 - RNA, 63 nt, Homo sapiens
cucacggcugaguugcugcgccugcagacggaagcuccccacaggcagagcugcuuggaugug

SEQ ID NO: 2454 - RNA, 63 nt, Homo sapiens
cucacucuccaucucaggaaauucuagcccuugcccucagggagccacgguugagggugaggc

SEQ ID NO: 2455 - RNA, 63 nt, Homo sapiens
cucagaagggagaggaggccuccaaaucuauugaguccccacaguuugcucaagcccaggcaa

SEQ ID NO: 2456 - RNA, 63 nt, Homo sapiens
cucagaagugcgccgccaugcugccuaggguacuguccccacaucugucccaacccagcugga

SEQ ID NO: 2457 - RNA, 63 nt, Homo sapiens
cucagagaaaaaaugauuugugugaaacugcccagcucagggauaaccagggacauucaccug

SEQ ID NO: 2458 - RNA, 63 nt, Homo sapiens
cucagagauucggccugaagguuaaaugagaugagugaauguauguuuggugcaguuucugga

SEQ ID NO: 2459 - RNA, 63 nt, Homo sapiens
cucagaggaggaggcucugaggcuguggagcugggcucagggaagaccaggggaggaugcaga

SEQ ID NO: 2460 - RNA, 62 nt, Homo sapiens
cucagggaacaauacuguaaacugucuuccugaacuacuguagggccucucuaagaauuuga

SEQ ID NO: 2461 - RNA, 63 nt, Homo sapiens
cucagggguuggucugagaggccugccauccaccccucagggagcuagguuuucucagaggcu

SEQ ID NO: 2462 - RNA, 63 nt, Homo sapiens
cucaggugcuccugcuggccugcccaagcccugcccucagggagcuucugccuuuuaagaacu

SEQ ID NO: 2463 - RNA, 63 nt, Homo sapiens
cucaggugggcaccuuccccugcagggugucugcccucagggaacucacggacucucagagac

SEQ ID NO: 2464 - RNA, 64 nt, Homo sapiens
cucaguuaaaaugugaggaagaacuacagcucuuaaauguagcaauggcacuguugcaaacuca

SEQ ID NO: 2465 - RNA, 63 nt, Homo sapiens
cucauaggguuguugugaggauuaaaaugaggaaaugaauguaaagcacuuaguacaguauau

SEQ ID NO: 2466 - RNA, 63 nt, Homo sapiens
cucaucacgggaggauaccugugugccggcagccccucagggacucucagcccuggcacuggc

SEQ ID NO: 2467 - RNA, 62 nt, Homo sapiens
cucaugcuaaaaguauguaaagaucccauguacaguaugauaguguacuuuuuuuaaaggac

SEQ ID NO: 2468 - RNA, 63 nt, Homo sapiens
cuccaaacauuguaagaauugcuugguagcauaagcucagggauaaggugggaauugaguuca

SEQ ID NO: 2469 - RNA, 61 nt, Homo sapiens
cuccacggucacguuccuguuuccuggaaucacuggugcuaugaacugggauucccaaagg

SEQ ID NO: 2470 - RNA, 63 nt, Homo sapiens
cuccacuccggaucgaggccuguauagggcucguuuccccacacaugccuauuucugaagagg

SEQ ID NO: 2471 - RNA, 62 nt, Homo sapiens
cuccagugcaguccauuuccuaauguauaccagccuacuguacuauuuaaaaugcucaauuu

SEQ ID NO: 2472 - RNA, 61 nt, Homo sapiens
cuccaguguccccgucuuugauuucccuggcgauggugcuagcuuaguuugugcgcaucgg

SEQ ID NO: 2473 - RNA, 63 nt, Homo sapiens
cuccaugaugacuuaguacaaaguuucaauuuguuuccccacaaaacaaagcaauucuuucaa

SEQ ID NO: 2474 - RNA, 63 nt, Homo sapiens
cuccauuacacgaucaccugcaucacagcccauggugaauguauguuucugcauagcgaaaua

SEQ ID NO: 2475 - RNA, 63 nt, Homo sapiens
cuccauuuaaaccaggugauaagaugauguaaauacucagggaggguauuaacuuguuacuuu

SEQ ID NO: 2476 - RNA, 63 nt, Homo sapiens
cuccccuagcaguuaaugccacuccagucucugcuugaauguaauaaaauaaaagaaaaguaa

SEQ ID NO: 2477 - RNA, 63 nt, Homo sapiens
cucccugaggcccucagacucauguuagccucacuuccccacaacccccaguuuccagccugc

SEQ ID NO: 2478 - RNA, 62 nt, Homo sapiens
cucccugggcccccaagugagauugcacauuuaacuacuguaaggagaggagcggcguuggc

SEQ ID NO: 2479 - RNA, 63 nt, Homo sapiens
cucccuucacacacccaggcuggagagacacugcgcucagggacggcuugaugguagccagga

SEQ ID NO: 2480 - RNA, 63 nt, Homo sapiens
cuccuagccugccaucccucaccugcagccaggcucucagggaagguccaugcugcuuggccu

SEQ ID NO: 2481 - RNA, 63 nt, Homo sapiens
cuccuccucagccagcggcagaagcagggcugaugcucagggaccccccaacccucaaaccuu

SEQ ID NO: 2482 - RNA, 63 nt, Homo sapiens
cuccuccucuccccaccuuugccauucuuaaguauugaauguacuuuguauaauuuuagugga

SEQ ID NO: 2483 - RNA, 63 nt, Homo sapiens
cuccugaguggaugacaggucuucauucucuaucuugaauguauuaugguuacuaauaguuuu

SEQ ID NO: 2484 - RNA, 63 nt, Homo sapiens
cuccuguuguaagaauuuucccaccucuucugacaugaauguagcauaaguuagcaaucgguu

SEQ ID NO: 2485 - RNA, 62 nt, Homo sapiens
cucgccuguuaaauuucaaauguccuguuugauacuacuguagaacacuauuuuuaauacag

SEQ ID NO: 2486 - RNA, 61 nt, Homo sapiens
cucggcucucccacaggugggcaccccccacuuuggugcuaauagcucuccaccagguggu

SEQ ID NO: 2487 - RNA, 62 nt, Homo sapiens
cucuagucggcccucuugcugcugccaaccaaaucaguauuagcuuugagcacugcacuguu

SEQ ID NO: 2488 - RNA, 63 nt, Homo sapiens
cucuaucaacaccagcuucucucucgggcuguuugcucagggaaggcaagaaagccacgugcu

SEQ ID NO: 2489 - RNA, 61 nt, Homo sapiens
cucuauccagcuaaauaggcuuggggaaagcuguggugcuacagaaaguacccuagacuua

SEQ ID NO: 2490 - RNA, 63 nt, Homo sapiens
cucucagacuauucugaguaaugcuugcuugcuaaugaauguauaggagaccacauuguaauu

SEQ ID NO: 2491 - RNA, 63 nt, Homo sapiens
cucucagagccucagcuucugggggagacaugcucuccccacaggggggaggcacuaagucau

SEQ ID NO: 2492 - RNA, 63 nt, Homo sapiens
cucucaucauauuugcaacucuucucucucuuucuuccccacacccaagaggaggauuggugg

SEQ ID NO: 2493 - RNA, 63 nt, Homo sapiens
cucuccuagugaggggcaggugggugugccccagguccccacacccacagggaggcuucacac

SEQ ID NO: 2494 - RNA, 62 nt, Homo sapiens
cucucuagucugaauggcuucauuguuucuuucucaguauuagaaauuauaguuacaaugaa

SEQ ID NO: 2495 - RNA, 62 nt, Homo sapiens
cucucuccagagcuuucaucugauaucucacaauguaugauauacguacaaaacacacagca

SEQ ID NO: 2496 - RNA, 62 nt, Homo sapiens
cucucucugcaguuauuuaaugccugugucagaucuacuguaaaaagaggauuaaguaaaau

SEQ ID NO: 2497 - RNA, 63 nt, Homo sapiens
cucucuggagacuucuugcuggaaugaacagugugcucagggacuauuuggaacuggauguuu

SEQ ID NO: 2498 - RNA, 63 nt, Homo sapiens
cucucuugucucuucccugccuccucccuuuucccuccccacauuuuguauaaaacuuuaauu

SEQ ID NO: 2499 - RNA, 61 nt, Homo sapiens
cucugacaaaaauacauguauuucauucucguauggugcuagaguuagauuaaucugcauu

SEQ ID NO: 2500 - RNA, 62 nt, Homo sapiens
cucugaggaucaccugcugucaaauugccaucuacaguauuacagcuuugcauuuggggguu

SEQ ID NO: 2501 - RNA, 62 nt, Homo sapiens
cucugauccaacccuguacugauaguacuucccaguaugauauugugauguuucauacaaug

SEQ ID NO: 2502 - RNA, 63 nt, Homo sapiens
cucugcaugcaacaguaaaaauuaauauaauauuuuccccacaaaagaaacacuuaacagagg

SEQ ID NO: 2503 - RNA, 64 nt, Homo sapiens
cucugccauagcacugaucagugacaauuuacaggaauguagcagcgauggaauuaccuggaac

SEQ ID NO: 2504 - RNA, 63 nt, Homo sapiens
cucugcccugguggaagcggcagccacaaguccuccucagggagccccaagggggauuuugug

SEQ ID NO: 2505 - RNA, 62 nt, Homo sapiens
cucuggcaaaccugugagugauuccacaaagauacaguauuacuuagcuaucugaauuauga

SEQ ID NO: 2506 - RNA, 62 nt, Homo sapiens
cucuguuacacuuuuuggaagugaaaacuuuguaguaugauagguuauuuugauguaaagau

SEQ ID NO: 2507 - RNA, 63 nt, Homo sapiens
cucuuccuccuauccugcgggaucacuggggggcucucagggaacagcagcagugccauagcc

SEQ ID NO: 2508 - RNA, 62 nt, Homo sapiens
cucuucuuucauuucuucuacaacucauacacucguaugauacuucgacacuguucuuagcu

SEQ ID NO: 2509 - RNA, 62 nt, Homo sapiens
cucuugaacuuuugguauaguaagguaacucuaacaguauuacugucuuuuucagcaauaac

SEQ ID NO: 2510 - RNA, 63 nt, Homo sapiens
cucuugcccaaggugagccagcccuggggacccagcucagggaggcucugcucagaguucggc

SEQ ID NO: 2511 - RNA, 63 nt, Homo sapiens
cugaaagaugcuaaucuauuugccaaacuuggucuugaauguacugggggcuucaagguaugg

SEQ ID NO: 2512 - RNA, 63 nt, Homo sapiens
cugaagacaugaaaacucacuggggagaaacccuaugaauguaaaaauguggaagcaacuuug

SEQ ID NO: 2513 - RNA, 63 nt, Homo sapiens
cugaaguaguguuuaggauccuccauggcaguuagugaauguaagaaguacaguguuaaagug

SEQ ID NO: 2514 - RNA, 62 nt, Homo sapiens
cugaauauaugggaacuucuguguuugggauguccuacuguaagacugaugaauguacagag

SEQ ID NO: 2515 - RNA, 63 nt, Homo sapiens
cugaaucacugcauggaugucccaggaggcagcucuccccacacagcagcacagccaucacag

SEQ ID NO: 2516 - RNA, 61 nt, Homo sapiens
cugaaugcaccucuuuaguaaguugcugauuuauggugcuaaagaaaaugauuauucccau

SEQ ID NO: 2517 - RNA, 63 nt, Homo sapiens
cugacaagcuauuauacaucucugguaaauccugcugaauguaagggauauucagagcuuuuc

SEQ ID NO: 2518 - RNA, 63 nt, Homo sapiens
cugacauccuguucuuuugcacuuacccugugcugugaauguaacagugggccuuggccccgc

SEQ ID NO: 2519 - RNA, 63 nt, Homo sapiens
cugaccuccugagcaggaccugggcccgguucagcuccccacaaggacuucucugucuggaga

SEQ ID NO: 2520 - RNA, 64 nt, Homo sapiens
cugacgacgggccagaugacccuugaaguagucauuauguagcaauaaaugaagccugaaacag

SEQ ID NO: 2521 - RNA, 61 nt, Homo sapiens
cugacgcguaacugcccauuuuaaggaaacucuuggugcuacaaaacccugaccagacacu

SEQ ID NO: 2522 - RNA, 62 nt, Homo sapiens
cugagacaaauuuuaacuucuugucuauaguugucaguauuauucuacuauacuguacauga

SEQ ID NO: 2523 - RNA, 63 nt, Homo sapiens
cugagagcggcugagggcugccucacugcaaauccuccccacagcgucagugaaagucguccu

SEQ ID NO: 2524 - RNA, 63 nt, Homo sapiens
cugagcccccuuuucuggacaccaacuguguccugugaauguaucgcuacugugagcuguucc

SEQ ID NO: 2525 - RNA, 63 nt, Homo sapiens
cugaguggucaggagccaguuucuccagccccuccuccccacaaccccuaguggggaggggca

SEQ ID NO: 2526 - RNA, 64 nt, Homo sapiens
cugauauuuuuaaaauucuaauaaucuucaucucaaauguagcauuaguauuucuaagugaaca

SEQ ID NO: 2527 - RNA, 62 nt, Homo sapiens
cugauugacuugccccaagggccacccgaggaagcaguauuaucugcgguggggggaggaga

SEQ ID NO: 2528 - RNA, 61 nt, Homo sapiens
cugauuugucuuauuuuuuucauacuuucccacuggugcuauuuuuauuuccaauggauau

SEQ ID NO: 2529 - RNA, 62 nt, Homo sapiens
cugauuuugcaauaagcuaagcucagaaacuuuccuacuguaaguucugguguacaucugag

SEQ ID NO: 2530 - RNA, 61 nt, Homo sapiens
cugcacgaacccuacagcgagagugacgaugauuggugcuaagcccgggcgaggccguaag

SEQ ID NO: 2531 - RNA, 62 nt, Homo sapiens
cugcagccucacucagaggggcccuuuuucuguacuacuguagucagcugggaauggggaag

SEQ ID NO: 2532 - RNA, 63 nt, Homo sapiens
cugcagcuggagggcuggggcaccugccccccugcuccccacacaucauauccuccccauacu

SEQ ID NO: 2533 - RNA, 63 nt, Homo sapiens
cugcauuaccuaauaauuaccucagcguuagaauuugaauguauuaauugauuuaaacaucau

SEQ ID NO: 2534 - RNA, 63 nt, Homo sapiens
cugccacagcugcagacugagagggugggucugaguccccacaaugucugaagcugccccugg

SEQ ID NO: 2535 - RNA, 61 nt, Homo sapiens
cugccagcuuccuuagaccaggcagggcugccauggugcuagcugcaaguccaucaguauu

SEQ ID NO: 2536 - RNA, 63 nt, Homo sapiens
cugccauuuuaccagcauuauuguaguuuaaugauugaauguagacagggauaugcguauagu

SEQ ID NO: 2537 - RNA, 63 nt, Homo sapiens
cugccccucgagggggcccugccugccgcggggccuccccacaagccccucccaaagcgccgg

SEQ ID NO: 2538 - RNA, 63 nt, Homo sapiens
cugccucccaaccagcaguuccagcccaucacuugcucagggacccccuaauccgucugccuc

SEQ ID NO: 2539 - RNA, 63 nt, Homo sapiens
cugccucuggcacccccuuucauugguuccauccauccccacaacagccugccaaucgaagcc

SEQ ID NO: 2540 - RNA, 63 nt, Homo sapiens
cugccugcaccaaacccagggauguggaagacaucuccccacaacugccacugcucaccagga

SEQ ID NO: 2541 - RNA, 62 nt, Homo sapiens
cugccuguaaauguuccccaaauaauuguuguguguaugauacguguauaauaaaaguauuc

SEQ ID NO: 2542 - RNA, 63 nt, Homo sapiens
cugccugugacuccucuccuccccggccccuaccccucagggauaaugaguucauugcugggc

SEQ ID NO: 2543 - RNA, 62 nt, Homo sapiens
cugcgaaauccagaacaaagcacaucagaaaaagcaguauuaacuucacagaaaaguaguga

SEQ ID NO: 2544 - RNA, 64 nt, Homo sapiens
cugcgcgggcuuauuuauuaacaggauaacccuugaauguagcagccccgggagggcggcacag

SEQ ID NO: 2545 - RNA, 63 nt, Homo sapiens
cugcucagcaggacacgugaacacccagacacccacucagggacucaagucucaccucccucc

SEQ ID NO: 2546 - RNA, 63 nt, Homo sapiens
cugcucccucucuuuccaucuguuuggcuuuuucccucagggaacuuggucuagaaggcacug

SEQ ID NO: 2547 - RNA, 63 nt, Homo sapiens
cugcucuguuugggugggagaagauucucuggggguccccacauccucccaaggcuccccuca

SEQ ID NO: 2548 - RNA, 61 nt, Homo sapiens
cugcugagaucugcuguccuguuucugucaagcuggugcuacuguuugauuuggaugauug

SEQ ID NO: 2549 - RNA, 62 nt, Homo sapiens
cugcuggaaaucacugcuuucauucccacaaaaccaguauuacuuuuuuuuaaaaaaagaaa

SEQ ID NO: 2550 - RNA, 62 nt, Homo sapiens
cugcuggccgaagaugucaccaaggccaaagacacaguauuaugaagguuuggaaaccccuc

SEQ ID NO: 2551 - RNA, 63 nt, Homo sapiens
cugcuucaugaguagaaaauuucaacaacucuuuuugaauguaugaagaguagcaguccccuu

SEQ ID NO: 2552 - RNA, 64 nt, Homo sapiens
cugcuugagcccaggaguuugagaccagccugggcaauguagcaagaccccaucucuauauaaa

SEQ ID NO: 2553 - RNA, 63 nt, Homo sapiens
cuggaggcauguuccccucaccaccccccgugggucucagggaggccgggugugaccucaucu

SEQ ID NO: 2554 - RNA, 64 nt, Homo sapiens
cuggaggcuggaggggagaggccaagcccuuggaaaauguagcaaaugucuggaugucgcauaa

SEQ ID NO: 2555 - RNA, 63 nt, Homo sapiens
cuggagugaauuaaguucaccugauaacucaaaagugaauguauaauacaauucuguuuuaau

SEQ ID NO: 2556 - RNA, 61 nt, Homo sapiens
cuggcagccuugacugaaagaugaaggaguccauggugcuaggaggaggaguugcauccca

SEQ ID NO: 2557 - RNA, 62 nt, Homo sapiens
cuggccugaccccuacccuccagcauugcucuuccuacuguacauauuggggaguggggggc

SEQ ID NO: 2558 - RNA, 63 nt, Homo sapiens
cuggcucagcuugggcaagggcugggccauaugugcucagggacgugcuucucuuguaaggca

SEQ ID NO: 2559 - RNA, 63 nt, Homo sapiens
cuggcuggcuuccuggaggcguucgccucuaguuucucagggauggagcgagagcccagccag

SEQ ID NO: 2560 - RNA, 63 nt, Homo sapiens
cuggcuucuacacuggguucugcuacuccccagaccucagggacaacugccggggguucaggg

SEQ ID NO: 2561 - RNA, 61 nt, Homo sapiens
cugggccucacggugcuccggcagcagagcgcauggugcuagccauggccggcugcagagg

SEQ ID NO: 2562 - RNA, 63 nt, Homo sapiens
cugggcgugguggcagacgccuguaaucccagcuacucagggaggcugaggcacgagaaucgc

SEQ ID NO: 2563 - RNA, 63 nt, Homo sapiens
cuggggaaaacaguuguggaauucuuacuucauuaugaauguauuuaaaaaacaaacaccaaa

SEQ ID NO: 2564 - RNA, 63 nt, Homo sapiens
cuggggaagggcaggccagccagcaccucugccuucucagggacaagaguaguccuuuaccac

SEQ ID NO: 2565 - RNA, 61 nt, Homo sapiens
cuggggccccuugaccucagcagagccgcuuccuggugcuacgcagccuccacacucagag

SEQ ID NO: 2566 - RNA, 61 nt, Homo sapiens
cuggggcuguauuuaucucugaggcaugguguguggugcuacagggaauuuguacguuuau

SEQ ID NO: 2567 - RNA, 63 nt, Homo sapiens
cugggugugucgucaucgucagaccguuccucacguccccacagaccccaggcccugugcaug

SEQ ID NO: 2568 - RNA, 63 nt, Homo sapiens
cugguaacaucugugcaagccccuuuccaggauucugaauguacaguauauaugaaugcauac

SEQ ID NO: 2569 - RNA, 61 nt, Homo sapiens
cugguggcauuguuuacagcuagaaagcugcacuggugcuaaugccccuuggggaaauggg

SEQ ID NO: 2570 - RNA, 62 nt, Homo sapiens
cuguaaccuuuugaaaucuaguuacuaauaagcacuacuguaauuuagcacaguuuaacucc

SEQ ID NO: 2571 - RNA, 62 nt, Homo sapiens
cuguaauaaauaaaaugguaguaaugaaugcaaucaguauuagccaaaauaaagaauuuaug

SEQ ID NO: 2572 - RNA, 62 nt, Homo sapiens
cuguagggucacuuuugauugaggcaaagggguccuacuguaaguggaaaagacucacuccc

SEQ ID NO: 2573 - RNA, 63 nt, Homo sapiens
cuguauuagauaguggugaucauugcacaacucugugaauguacuaaaaaucauugaauugua

SEQ ID NO: 2574 - RNA, 63 nt, Homo sapiens
cugucacugaggguuuugguuggcaucguuguuuuugaauguagcacaagcgaugagcaaacu

SEQ ID NO: 2575 - RNA, 62 nt, Homo sapiens
cugucauucucacgacuccgggagaaacugugcuguaugauacagaucuauuuuaauacacu

SEQ ID NO: 2576 - RNA, 63 nt, Homo sapiens
cugucccagcuggcccugugccuccaacccagagcuccccacagaccugguguaauuucacaa

SEQ ID NO: 2577 - RNA, 63 nt, Homo sapiens
cuguccucaccuuccagccccagcugagcagccccuccccacaucaucuucagcugcugccca

SEQ ID NO: 2578 - RNA, 62 nt, Homo sapiens
cugucucucuuuauacauccuuguaugguucucccaguauuagcaagauuguauaucuguaa

SEQ ID NO: 2579 - RNA, 62 nt, Homo sapiens
cugugaagaugacccaaaguuuccaacuccuuuacaguauuaccgggacuaugaacuaaaag

SEQ ID NO: 2580 - RNA, 63 nt, Homo sapiens
cugugcaauguuuuaaguucacaaguuccugcuccuccccacacugagcuccuuuguuccucc

SEQ ID NO: 2581 - RNA, 53 nt, Homo sapiens
cugugcuuuugcccccccuccccccuccccacaaacgugagaccugcgacaaa

SEQ ID NO: 2582 - RNA, 63 nt, Homo sapiens
cugugugccguccccuuuagcugccuccuauugaucucagggaagccugggagucccuucuca

SEQ ID NO: 2583 - RNA, 61 nt, Homo sapiens
cuguguuacgacauuaauugcaaauagcaaguauggugcuaaagucuacaccaauggaauu

SEQ ID NO: 2584 - RNA, 63 nt, Homo sapiens
cuguuacuccuuuggcccauagcuaaggucauccuuccccacagggguggcuuugggauugga

SEQ ID NO: 2585 - RNA, 63 nt, Homo sapiens
cuguuauugaaauauuacagauggaaagaaugaggcucagggaaguuaaaugacuuggccaag

SEQ ID NO: 2586 - RNA, 63 nt, Homo sapiens
cuguuccaaaacaaaauucaccuccuuucuuuaugugaauguauucuccauaaaauuccagua

SEQ ID NO: 2587 - RNA, 63 nt, Homo sapiens
cuguucuggggcuuguccuuccuuugcagcuguuuugaauguaguuuuccuuuucuauuuauu

SEQ ID NO: 2588 - RNA, 62 nt, Homo sapiens
cuguucuugguuuuauuguuccacuugaauauuucuacuguaaaaaaaagacagugguuuug

SEQ ID NO: 2589 - RNA, 62 nt, Homo sapiens
cuguuguuuuuugaagugccaaucccaugccaugcaguauuaugucccucuccuaucugugu

SEQ ID NO: 2590 - RNA, 63 nt, Homo sapiens
cuguuucucccuugggacugugucucauguuugugugaauguagaccaggaaagggggcugca

SEQ ID NO: 2591 - RNA, 63 nt, Homo sapiens
cuguuugcuauuuugcauggugggaucucuggccccucagggacuugagauuauuuaaguacu

SEQ ID NO: 2592 - RNA, 62 nt, Homo sapiens
cuuaaaugccuaccucugugcugaagcugacagacaguauuaacucuuaucaaggccaucuu

SEQ ID NO: 2593 - RNA, 62 nt, Homo sapiens
cuuaaauuaugugaacuauuaaauagacccuacuguacugugcuuuggacauuugaauuaau

SEQ ID NO: 2594 - RNA, 63 nt, Homo sapiens
cuuaacauuauaauuaugauauuuguccagacuauugaauguagcuguaguuuauucauuuuu

SEQ ID NO: 2595 - RNA, 64 nt, Homo sapiens
cuuaauacucaagugauguuugucucuaguguucuaauguagcacaaauccuauguaaaaucau

SEQ ID NO: 2596 - RNA, 63 nt, Homo sapiens
cuuaauauuaauggacuguuucagguaaaagagaaugaauguaugauugugaacugugaagag

SEQ ID NO: 2597 - RNA, 62 nt, Homo sapiens
cuuaauucugcuagaguuaaccuugaguucagagcaguauuaaaugcgugcacuuucagguc

SEQ ID NO: 2598 - RNA, 63 nt, Homo sapiens
cuuacauagcacuugauacguguuaaaugaacauaugaauguaauuuauauauuccuagaauu

SEQ ID NO: 2599 - RNA, 62 nt, Homo sapiens
cuuaccgucaugucuugcaacaacccugugagggcaguauuaaugcccccuuacagcagaag

SEQ ID NO: 2600 - RNA, 63 nt, Homo sapiens
cuuaccuuuuccuauucuguugccaauuuuuguuuuccccacauucuauagccauaaaccuga

SEQ ID NO: 2601 - RNA, 62 nt, Homo sapiens
cuuacggacagcauauaauucucccugcaaggauguaugauaauauguacaaaguaauucca

SEQ ID NO: 2602 - RNA, 64 nt, Homo sapiens
cuuacuacuaaaagcuguccacuguagaguugcuguauguagcaauguguauccacucuacagu

SEQ ID NO: 2603 - RNA, 63 nt, Homo sapiens
cuuacucuaugagucuucauuuuucuaaaauaaagugaauguauuuuuauauucucuguagau

SEQ ID NO: 2604 - RNA, 62 nt, Homo sapiens
cuuagaauuaauugauaaaugucucuuuuaaaaucuacuguauuuauuauaauuuacacccu

SEQ ID NO: 2605 - RNA, 64 nt, Homo sapiens
cuuagccaguuuuuguaauaauggcaaaucucucccauguagcaauucccugcuccuuuuuccu

SEQ ID NO: 2606 - RNA, 62 nt, Homo sapiens
cuuaggauuucugacuuuuuauuaauuucuuaaccuacuguaaauaaacuucaccugaccag

SEQ ID NO: 2607 - RNA, 63 nt, Homo sapiens
cuuagugacccccaucuuguaaccuguugcaagagugaauguaaaaaauaguuguggcauuuu

SEQ ID NO: 2608 - RNA, 63 nt, Homo sapiens
cuuauauuuauaguggguuucacagacuauaaaauugaauguaugaaauuuuuauuuauauca

SEQ ID NO: 2609 - RNA, 62 nt, Homo sapiens
cuuaugacagugaggccuucuuuggcuccaccuaguaugauaaucauggguucuguuuuagu

SEQ ID NO: 2610 - RNA, 63 nt, Homo sapiens
cuucacucagagaagcaaggcugauauuagcuuguugaauguaagagacacaaaugaagaaga

SEQ ID NO: 2611 - RNA, 63 nt, Homo sapiens
cuucagaucggcuaggauucuuugaauacaaauaaugaauguaaacaauuaacuguuuauaau

SEQ ID NO: 2612 - RNA, 63 nt, Homo sapiens
cuucaucucuuuagagaaguccaagcaacagccuuugaauguaaccaauccuacuaauaaacc

SEQ ID NO: 2613 - RNA, 63 nt, Homo sapiens
cuucaugugagaagucacacaggggagaaacccuaugaauguaauaaaugugggaaagccuuu

SEQ ID NO: 2614 - RNA, 61 nt, Homo sapiens
cuucauuaaugaugaucuucagauuaaacccuuuggugcuaggagcugacaauuuccaaag

SEQ ID NO: 2615 - RNA, 62 nt, Homo sapiens
cuucauuucuuuuuauggccgaaauuacuccauuguaugauaugccauguuucuuuauccau

SEQ ID NO: 2616 - RNA, 64 nt, Homo sapiens
cuuccaccuagagcauuccgucucucauccucugccauguagcaaacugcuaugcauccuucag

SEQ ID NO: 2617 - RNA, 63 nt, Homo sapiens
cuuccccagauucucaagcagaugcccaagggagguccccacagagccagagugccugaggcu

SEQ ID NO: 2618 - RNA, 63 nt, Homo sapiens
cuucccccuccuugaggcaggaauacugaggugccuccccacagauggagaagguggagagga

SEQ ID NO: 2619 - RNA, 62 nt, Homo sapiens
cuucccucccauuuuccuuguuccugaacuaauacuacuguaccuguuauggaggacugcaa

SEQ ID NO: 2620 - RNA, 62 nt, Homo sapiens
cuucccuuucucuuuuggacaauaguuaaauuagcaguauuaguuaugaguuugguugcagu

SEQ ID NO: 2621 - RNA, 63 nt, Homo sapiens
cuuccuguugaacuuccuauguucuuucucaagugcucagggaucuaaguuaguggacagcaa

SEQ ID NO: 2622 - RNA, 62 nt, Homo sapiens
cuuccuuugaucauuucaugugaauauucuauuuguaugauacacuguauuucaauaaauuc

SEQ ID NO: 2623 - RNA, 63 nt, Homo sapiens
cuucguauuaucaugggaguacuguaaguucaguucucagggaaugcuaaauuagaguaauaa

SEQ ID NO: 2624 - RNA, 63 nt, Homo sapiens
cuucuacucucugggccuuguuuucuccucugugacucagggauaggagucaucagccuggau

SEQ ID NO: 2625 - RNA, 63 nt, Homo sapiens
cuucuacuuuugccuucuagggggagcuuucuaaguccccacauuuaccccgagucaccggaa

SEQ ID NO: 2626 - RNA, 63 nt, Homo sapiens
cuucuauucauuauuuuacgccucagagcaaggcccucagggagggucauccuccauguuuug

SEQ ID NO: 2627 - RNA, 63 nt, Homo sapiens
cuucuauuucuuauggggccaucuuggccucaccauccccacacgugccgaugucagguucau

SEQ ID NO: 2628 - RNA, 63 nt, Homo sapiens
cuucuccuuugaaugcuguuuugugaaagaaacugugaauguaauggaaacguaggagcaucu

SEQ ID NO: 2629 - RNA, 61 nt, Homo sapiens
cuucucgagcaggagugauaguuaccuucacaauggugcuaccccuugcccaggcaaggaa

SEQ ID NO: 2630 - RNA, 63 nt, Homo sapiens
cuucucugcccugcccuggccacuggcccuguuucuccccacacccuggaguggcaugguccu

SEQ ID NO: 2631 - RNA, 62 nt, Homo sapiens
cuucucugucucaugugugcucuucuucuuucuacaguauuauguacucuacugauaucuaa

SEQ ID NO: 2632 - RNA, 63 nt, Homo sapiens
cuucugccccugcccuuccucacacugacacuuuguccccacaugggguggggagcagagugc

SEQ ID NO: 2633 - RNA, 62 nt, Homo sapiens
cuucuuauuuuuuugaaaagacaauuuuccauuucaguauuacauuuuaccaagaagucacu

SEQ ID NO: 2634 - RNA, 63 nt, Homo sapiens
cuucuucucauugcugaagccccucugugucucuucucagggacaggcugguccaguggcuuu

SEQ ID NO: 2635 - RNA, 64 nt, Homo sapiens
cuucuugugcaugucugcucugauauacgucgaacaauguagcagccacugucauuucucagug

SEQ ID NO: 2636 - RNA, 61 nt, Homo sapiens
cuucuuuucuuuugcaugcauuuuuccccuguuuggugcuauguuuauguauuaugcuuga

SEQ ID NO: 2637 - RNA, 64 nt, Homo sapiens
cuugacucucccggcucugccacuguuuucugagaaauguagcauccgcugcagcuggccacac

SEQ ID NO: 2638 - RNA, 63 nt, Homo sapiens
cuugaggcccaggccagggcagccaguggcucuagcucagggaaagccaggcccaccugcccu

SEQ ID NO: 2639 - RNA, 63 nt, Homo sapiens
cuugccacuccuagcuccagaagggcucagggccuuccccacagaucuaaggacugggcuacc

SEQ ID NO: 2640 - RNA, 63 nt, Homo sapiens
cuugcucucaguagcgucagccccaguucugagccuccccacauuacacuuaacaagcaguaa

SEQ ID NO: 2641 - RNA, 63 nt, Homo sapiens
cuuggagcuggugggcaccucccuguucugcacagcucagggacuuagccagguccucuccug

SEQ ID NO: 2642 - RNA, 63 nt, Homo sapiens
cuuggcggcaaagcccagccccuucucagaccagcuccccacauuccugaauuccacuuccag

SEQ ID NO: 2643 - RNA, 51 nt, Homo sapiens
cuuggcucuaugcuccugaaauccucagggaucucucuuguggucgguugu

SEQ ID NO: 2644 - RNA, 61 nt, Homo sapiens
cuuggggagaccaaaagucggacaggaaacaucuggugcuauuaucugggacuuggccuga

SEQ ID NO: 2645 - RNA, 62 nt, Homo sapiens
cuugguuauacaugacacugaaaugccuuacuuuguaugauauuccauaguauauuaaaaau

SEQ ID NO: 2646 - RNA, 64 nt, Homo sapiens
cuugucauuauucucugaacaauacaagaacucuuuauguagcauuuacauuuauuagguauua

SEQ ID NO: 2647 - RNA, 62 nt, Homo sapiens
cuuguuagugaacaggccuguuuuaaauaucuuaguaugauaucaaaagaauaaucaauuua

SEQ ID NO: 2648 - RNA, 63 nt, Homo sapiens
cuuguugccuuugagccagauccauggcaauggucuccccacagaccgcaggacugagccugg

SEQ ID NO: 2649 - RNA, 61 nt, Homo sapiens
cuuguuguuugcgcauuuuuuuuuaaagcauauuggugcuagaaaaggcagcuaaaggaag

SEQ ID NO: 2650 - RNA, 63 nt, Homo sapiens
cuuguuugaauuaauuguauuguaauauuauuuguugaauguaguaauuagguauuuaugaau

SEQ ID NO: 2651 - RNA, 63 nt, Homo sapiens
cuuuaaaaauuaaaaauggauggaucuucucugaacucagggagggcacauacuuagauaccu

SEQ ID NO: 2652 - RNA, 61 nt, Homo sapiens
cuuuaauauaucauuugaaguuucagacaauuuuggugcuaauuacuuuuugugaguuuuu

SEQ ID NO: 2653 - RNA, 62 nt, Homo sapiens
cuuuaauuucacuaugcuuucagcuuacuuuauuguaugauauguaggucuaaaauauaguu

SEQ ID NO: 2654 - RNA, 63 nt, Homo sapiens
cuuuacaauuucaaauguuacccugauuguuuauaugaauguagaacaccuugacauuucuuu

SEQ ID NO: 2655 - RNA, 63 nt, Homo sapiens
cuuuaggccuguaggccuuuccugugugccugcaucucagggagggucucucuccauguuguu

SEQ ID NO: 2656 - RNA, 62 nt, Homo sapiens
cuuuagggaugauuuuugccauuuccaguccacgguaugauacuaaagcugucaagagaggu

SEQ ID NO: 2657 - RNA, 63 nt, Homo sapiens
cuuuagguuuuucuugaagaauuaggaaaguaccauccccacagauucagcauacucuucagg

SEQ ID NO: 2658 - RNA, 64 nt, Homo sapiens
cuuuaguaauguggauuuuuuucuuuuuuaaaagagauguagcagaauaauucuuccagugcaa

SEQ ID NO: 2659 - RNA, 63 nt, Homo sapiens
cuuuauuugcacgucaggggagccggcuccccccuugaauguaccagacccugggggggguca

SEQ ID NO: 2660 - RNA, 64 nt, Homo sapiens
cuuucagacuuuuuccuauacauuuuauauguagaaauguagcaauguauuuguauagauguga

SEQ ID NO: 2661 - RNA, 62 nt, Homo sapiens
cuuuccagucugauucacguuagcaguguguacacuacuguaucaucaucagcuucaucacc

SEQ ID NO: 2662 - RNA, 63 nt, Homo sapiens
cuuuccuccugucuuagaagaacagaccuaacuagugaauguauuaaugaaaaugcaucuauu

SEQ ID NO: 2663 - RNA, 63 nt, Homo sapiens
cuuucuaauuaggcauuuuauguuagucacagucuugaauguauaaacagcacuaagacucuc

SEQ ID NO: 2664 - RNA, 63 nt, Homo sapiens
cuuucugugcuacccacuuguuagauuccagccaccucagggauucugauccaugucauuaac

SEQ ID NO: 2665 - RNA, 61 nt, Homo sapiens
cuuucuucagcuaaugauuacugagcaccuguuuggugcuaaggauauggucauuuacaag

SEQ ID NO: 2666 - RNA, 63 nt, Homo sapiens
cuuugaugcgcaugcacauuggggaagaugcgcuccucagggacacaaaggccgaguggggua

SEQ ID NO: 2667 - RNA, 62 nt, Homo sapiens
cuuugauuaccgacuacacaauuauguaccaucacaguauuaguggaaaaguaccaugugau

SEQ ID NO: 2668 - RNA, 63 nt, Homo sapiens
cuuugcugggauggaagauuugggccguguggugccucagggaaguucugguuacagagaaaa

SEQ ID NO: 2669 - RNA, 63 nt, Homo sapiens
cuuuggaugccagcccaggaugaguaguuccuguucucagggaggucauccgcugagcauccc

SEQ ID NO: 2670 - RNA, 63 nt, Homo sapiens
cuuuuaauuugauuuuagaaucuggacacuuucuaugaauguaauucggcugagaaacauguu

SEQ ID NO: 2671 - RNA, 62 nt, Homo sapiens
cuuuuaugauaguuauuccaaauucaagaagaagcaguauuaacaucaauugaucgacacaa

SEQ ID NO: 2672 - RNA, 63 nt, Homo sapiens
cuuuuauuuuguguccuugggcuauaaaagauuccugaauguaauuauaaggauuuggguuug

SEQ ID NO: 2673 - RNA, 63 nt, Homo sapiens
cuuuucaaggcaaagugaagaugacaguccuugcucucagggagcccccacuuuaaugggaga

SEQ ID NO: 2674 - RNA, 63 nt, Homo sapiens
cuuuuccugucugacucugacaaguccucccucacugaauguagaaucguugccaaguuucug

SEQ ID NO: 2675 - RNA, 64 nt, Homo sapiens
cuuuugaagacuguuauauacaugaaauuauaugguauguagcauuuugagagcgacuucuuuu

SEQ ID NO: 2676 - RNA, 62 nt, Homo sapiens
cuuuuggagagaauguugauuggcaaaagcagcacaguauuaauauuuagaguaggaugcag

SEQ ID NO: 2677 - RNA, 62 nt, Homo sapiens
cuuuuuaauuuaaugugcucgcacuacaaugcaucaguauuaugauuccucuguacuuuccu

SEQ ID NO: 2678 - RNA, 64 nt, Homo sapiens
cuuuuuauauauuuuugauauuaauccuuugucauuauguagcagauguuuuucuuaaucuagc

SEQ ID NO: 2679 - RNA, 62 nt, Homo sapiens
cuuuuucaguggguauuuuucugucucccaaccucuacuguaaacuuucugguccgagaacg

SEQ ID NO: 2680 - RNA, 61 nt, Homo sapiens
gaaaaaaaagauuuguuucugaaagacuucuuauggugcuauuccauaaacuuuuuuucaa

SEQ ID NO: 2681 - RNA, 62 nt, Homo sapiens
gaaaaagugccaaacaggacuauaaaauuguggucuacuguaaaugguuugcaguaaaaguu

SEQ ID NO: 2682 - RNA, 64 nt, Homo sapiens
gaaaaaugccuacugauaauuccuuuagucuugaaaauguagcauuuguuaggaguuaaaagag

SEQ ID NO: 2683 - RNA, 61 nt, Homo sapiens
gaaaacacaggcugcugaaguuuuuuggaaugcuggugcuaaccacuugcuagauuuaacu

SEQ ID NO: 2684 - RNA, 62 nt, Homo sapiens
gaaaacacuaagucaugaaacagaaaaacagaagguaugauaauaauaguaauaacaguuaa

SEQ ID NO: 2685 - RNA, 64 nt, Homo sapiens
gaaaacuacauagguuauuuugaucucuuaagauuaauguagcagaaauuucuuggaauuuuau

SEQ ID NO: 2686 - RNA, 61 nt, Homo sapiens
gaaaaggaaaaauuaugagagagagagagacauuggugcuaaguaaugaucuuccuaaaga

SEQ ID NO: 2687 - RNA, 63 nt, Homo sapiens
gaaaaggggcauugagacuauaaagcaguagacaauccccacauaccaucuguagaguuggaa

SEQ ID NO: 2688 - RNA, 61 nt, Homo sapiens
gaaaauguccagggcuuugaucaccaugcaaaguggugcuaucuucuagguucuuuccagc

SEQ ID NO: 2689 - RNA, 64 nt, Homo sapiens
gaaaaugugaagcugaacccccuccagacacccagaauguagcaucugagaaggcccugugccc

SEQ ID NO: 2690 - RNA, 62 nt, Homo sapiens
gaaacaauaaaauccaacagaaaggaagagauagcuacuguauauuacaguaaagaaagcug

SEQ ID NO: 2691 - RNA, 63 nt, Homo sapiens
gaaacagacagaaaggguggaguaauuuguccaaguccccacagcuagaaagugccagagucg

SEQ ID NO: 2692 - RNA, 63 nt, Homo sapiens
gaaaccaagaaauguaaucaagcaguaaaaacaucugaauguagaccaugaucucaaguucuu

SEQ ID NO: 2693 - RNA, 62 nt, Homo sapiens
gaaacuauuuuauauucaaucuaguuuauuuagucuacuguauuucuauuucguggaagccu

SEQ ID NO: 2694 - RNA, 63 nt, Homo sapiens
gaaacuguaggaaauacaugacagagaaaguuacacucagggagcagcagcaccuccagacug

SEQ ID NO: 2695 - RNA, 62 nt, Homo sapiens
gaaagcacuuuagggauuguagauggcuaacaagcaguauuaaaauuucaggagccaaguca

SEQ ID NO: 2696 - RNA, 55 nt, Homo sapiens
gaaagucauugcacaauaagggauuuuugaauguauaauaucaucuaaggugggc

SEQ ID NO: 2697 - RNA, 64 nt, Homo sapiens
gaaaguuucaugaugguaucuauagucaagacgaacauguagcauggugccuauguagacaaua

SEQ ID NO: 2698 - RNA, 61 nt, Homo sapiens
gaaaguuugccaggaggaacaaagagauugugguggugcuaaaggaggccauaagcuacac

SEQ ID NO: 2699 - RNA, 62 nt, Homo sapiens
gaaauaucuuuuagaaguguuaaaauaaauguuccuacuguauauuuaaaauugggggaaag

SEQ ID NO: 2700 - RNA, 64 nt, Homo sapiens
gaaauauuugagguagacggggcccucuuuugguggauguagcacaauuuccacacugugaagg

SEQ ID NO: 2701 - RNA, 62 nt, Homo sapiens
gaaaucacuguuguucagcuaucaccuuaauuguguaugauaugauaaauguuuagcaguaa

SEQ ID NO: 2702 - RNA, 63 nt, Homo sapiens
gaaaucauacagcugaggaaacccuaugaauguaaggaauguggaaaagccuucagcaggaaa

SEQ ID NO: 2703 - RNA, 63 nt, Homo sapiens
gaaaucguuucccaccccacaucuccuucagaccucucagggacaacucugggaggcagccuu

SEQ ID NO: 2704 - RNA, 61 nt, Homo sapiens
gaaauuuacauaucaaguacugcaaauaaaagguggugcuaugauauaugcuuaggaggac

SEQ ID NO: 2705 - RNA, 64 nt, Homo sapiens
gaacaaauggccaguggaaauucuuaacuuccauguauguagcauggauauuugcagaugcaua

SEQ ID NO: 2706 - RNA, 62 nt, Homo sapiens
gaacacacacguuuucccuacagcagaggccaugcaguauuauauauucauuuugcagaauc

SEQ ID NO: 2707 - RNA, 63 nt, Homo sapiens
gaacacuuaaaucuaacagaggauuuucagaguagugaauguaaggaaagcuuaauggaucuc

SEQ ID NO: 2708 - RNA, 63 nt, Homo sapiens
gaacagaacauagacagaagaaacaagguuuucaguccccacagauaacugaaaauuauuuaa

SEQ ID NO: 2709 - RNA, 63 nt, Homo sapiens
gaacaucccgcuucugaagcugcugcagcucccuccucagggaucacacugccgucacccacu

SEQ ID NO: 2710 - RNA, 64 nt, Homo sapiens
gaacugccaacaaaauaaaaauaaaaagucuucacuauguagcaucagcaaccuggauuuggcu

SEQ ID NO: 2711 - RNA, 63 nt, Homo sapiens
gaacugcccagccugcuccuggcccccuggaagccuccccacagcugguaaucuggacuuaag

SEQ ID NO: 2712 - RNA, 63 nt, Homo sapiens
gaacuggacuccggcauaagccacuuccccacaaacccccaccagcaaggggcuggggccagg

SEQ ID NO: 2713 - RNA, 63 nt, Homo sapiens
gaacuguaugucaaauaauucaaaaggggcaaaacugaauguaguuaugugggaaagccuuca

SEQ ID NO: 2714 - RNA, 62 nt, Homo sapiens
gaagauaauuugugggcagggguggaggaugcauguaugauacuccauaaauucaacauucu

SEQ ID NO: 2715 - RNA, 62 nt, Homo sapiens
gaagauaguaggaaauggaguacagaaaggcauacaguauuauguuacaguggagugcuuuc

SEQ ID NO: 2716 - RNA, 63 nt, Homo sapiens
gaagcagagcagaugauucgagcagcauuuguuucuccccacaucuagaaauuguaguucaua

SEQ ID NO: 2717 - RNA, 63 nt, Homo sapiens
gaagcugauuugcaacauuugcuaaauggauuagaugaauguacuucuuuuugugagcuuacu

SEQ ID NO: 2718 - RNA, 63 nt, Homo sapiens
gaaggaaucauuggugaacuuuccaagguuauuucugaauguaacaauuuccuuaaaaaugac

SEQ ID NO: 2719 - RNA, 63 nt, Homo sapiens
gaaggacugggagagacacaaagaccagagccagccucagggacaagagauuccaguuuuagg

SEQ ID NO: 2720 - RNA, 63 nt, Homo sapiens
gaagggagcaucaggagaggaacaaaaaaagggaucucagggagaggccagugucaaacuuga

SEQ ID NO: 2721 - RNA, 63 nt, Homo sapiens
gaaguaccuggagcaucauucucuucuaccacaucugaauguaacuuaaauuugcucaaagaa

SEQ ID NO: 2722 - RNA, 63 nt, Homo sapiens
gaaguagcucauuuucucuuacuaauguuugguuccucagggaagaaucucacuugacuagag

SEQ ID NO: 2723 - RNA, 61 nt, Homo sapiens
gaaguguuacuaucuugauuugaacaaauuuucuggugcuaagucugauguucuuuccaug

SEQ ID NO: 2724 - RNA, 62 nt, Homo sapiens
gaaguucuucaguuuuuaagugaggauaucgugacaguauuaaaacaucgcaauaauguucc

SEQ ID NO: 2725 - RNA, 63 nt, Homo sapiens
gaaguuuuuaaaaaaugauacccuguuuuauauuuugaauguagagagacucugagagagaga

SEQ ID NO: 2726 - RNA, 62 nt, Homo sapiens
gaauaaauaagucacagagaauguaaauuuuguacaguauuagaauguguaaaugaagcuug

SEQ ID NO: 2727 - RNA, 63 nt, Homo sapiens
gaauaaucuuccauuuggcugucgugaggaguaauugaauguaauccaucucuuacaaaaugg

SEQ ID NO: 2728 - RNA, 62 nt, Homo sapiens
gaauacagucauuccaagaacuauaaacuuaaagcuacuguagaaacaaaggguuuucuuuu

SEQ ID NO: 2729 - RNA, 63 nt, Homo sapiens
gaauacaugcaaaacacacacuggagagaaaccuaugaauguaaggaaugcaaacaagcauuc

SEQ ID NO: 2730 - RNA, 64 nt, Homo sapiens
gaauagcuaauuacagucuauuaaaacugugaauguauguagcaauccugcgugugaaggcaaa

SEQ ID NO: 2731 - RNA, 62 nt, Homo sapiens
gaaucagaggcuaaaaauauuaccccauauguuccaguauuagucauggauugcaaaggcuu

SEQ ID NO: 2732 - RNA, 62 nt, Homo sapiens
gaauggcagggaucuauuuuauugaauauucuagcuacuguaacauugauauuuauuuuugu

SEQ ID NO: 2733 - RNA, 62 nt, Homo sapiens
gaauguuagucaucguuauuauauucaucaucaucaguauuauuauuuguagaaaggcuuuu

SEQ ID NO: 2734 - RNA, 62 nt, Homo sapiens
gaauuauaucuuuguaaaucucucaauacucaaucuacuguaaguacccagggaggcuaauu

SEQ ID NO: 2735 - RNA, 63 nt, Homo sapiens
gaauuucucugauuugugggcacaguuaugaaguuuccccacaugugaagacagguacaaaau

SEQ ID NO: 2736 - RNA, 62 nt, Homo sapiens
gaauuuugcaagcugauuguuaauuaaguacagucaguauuaaaaaugauauacauuuacaa

SEQ ID NO: 2737 - RNA, 63 nt, Homo sapiens
gaauuuuguuccaccaugguuaguuauuugccauaugaauguauucuuguuucuaccaauauu

SEQ ID NO: 2738 - RNA, 62 nt, Homo sapiens
gacaaacaaacaacaucaaggcaaauccaauaaucaguauuaccauggcaaaaagaggaaac

SEQ ID NO: 2739 - RNA, 63 nt, Homo sapiens
gacaaagcccaucccaggagacggggugaagcuauuccccacacucuccugugaacacuggag

SEQ ID NO: 2740 - RNA, 63 nt, Homo sapiens
gacaagagacccagcccacaacagcaccagucagcuccccacacaaggcagcuugggucugca

SEQ ID NO: 2741 - RNA, 63 nt, Homo sapiens
gacaauagcccaaagccaagaaagaaaaauuaucuugaauguaguauucaaugauuuuuuaug

SEQ ID NO: 2742 - RNA, 64 nt, Homo sapiens
gacacccuggccagcgcgggggacuuucucugcaccauguagcauacuggacucccagcccugc

SEQ ID NO: 2743 - RNA, 63 nt, Homo sapiens
gacaccgcggcgaaugcagaugacugcaccggccacucagggagcugccugggcuccgugucu

SEQ ID NO: 2744 - RNA, 62 nt, Homo sapiens
gacacucaaaauccuucagaucuggaaaccggcucaguauuaacccuaccuuugguuguccu

SEQ ID NO: 2745 - RNA, 62 nt, Homo sapiens
gacacugacagauguguuugcaaggauacggcuucaguauuacuaauuuccauguguaucug

SEQ ID NO: 2746 - RNA, 62 nt, Homo sapiens
gacagagcugguggggcgcgggggggcuggcgagcuacuguaaacuuuaaagaauuccugca

SEQ ID NO: 2747 - RNA, 62 nt, Homo sapiens
gacaggaggugaugaaccuuuuuaugugcagcugguaugauagaaggaaauugggaaaacuu

SEQ ID NO: 2748 - RNA, 63 nt, Homo sapiens
gacauccuccaugugagaagcagcgaacauugaaucucagggauggcccacaacuggguccac

SEQ ID NO: 2749 - RNA, 63 nt, Homo sapiens
gacaucuacauuuuuuaaaacugaaucuuaaucgaugaauguaaacucgggggugcuggggcc

SEQ ID NO: 2750 - RNA, 61 nt, Homo sapiens
gacauuuacugaguuuuugcuucauguuagauauggugcuaaguuuuaaucauucaaggaa

SEQ ID NO: 2751 - RNA, 63 nt, Homo sapiens
gaccacaccccaaucucagagcuaacauccacacuuccccacauuuccugcuugccaguaaag

SEQ ID NO: 2752 - RNA, 63 nt, Homo sapiens
gaccacccccaucgagugcggagagagugggagugcucagggaaagaaggugauuuguauuug

SEQ ID NO: 2753 - RNA, 63 nt, Homo sapiens
gaccacuguguuggugguggggccucaugcuguggcucagggagggccccucccugcauguga

SEQ ID NO: 2754 - RNA, 63 nt, Homo sapiens
gaccagcugcaucucccaggcgggaugccgagcuccucagggacagcugagccccaaccgggc

SEQ ID NO: 2755 - RNA, 63 nt, Homo sapiens
gacccagccuucugggggugcuaugaggugauccguccccacacaugggaugggggaggcaga

SEQ ID NO: 2756 - RNA, 61 nt, Homo sapiens
gaccccaccccucugcugguccugccaacguguuggugcuauaagcugcuucagauauaaa

SEQ ID NO: 2757 - RNA, 62 nt, Homo sapiens
gacccuacaacugcccugggacauuucacuguaccaguauuaacugcaaacagcaauaauug

SEQ ID NO: 2758 - RNA, 63 nt, Homo sapiens
gaccuaccucaaacacacuguuuccacccucuucuugaauguauucaguagccuuuacugaau

SEQ ID NO: 2759 - RNA, 64 nt, Homo sapiens
gaccuaguaugaacuggugucugcccagagagcagcauguagcaggggggaaugcucagguuug

SEQ ID NO: 2760 - RNA, 63 nt, Homo sapiens
gaccucuggauccagcugaccugacaggucaucuacucagggaggagcccugugcucccagcu

SEQ ID NO: 2761 - RNA, 63 nt, Homo sapiens
gaccuggguauccccugccuccugccaccccuuccuccccacacuccacucugauucaccucu

SEQ ID NO: 2762 - RNA, 63 nt, Homo sapiens
gaccuuuggggcuggggagccggggcugcgccuguugaauguaagaggacugcugaccagagg

SEQ ID NO: 2763 - RNA, 61 nt, Homo sapiens
gacgcaugcaagacucagacccggggaaugguguggugcuaaucucaacaccugacauuca

SEQ ID NO: 2764 - RNA, 62 nt, Homo sapiens
gacgcguuuguccaacagcucauuggcucccuuuguaugauaucguggucuucucacauggu

SEQ ID NO: 2765 - RNA, 63 nt, Homo sapiens
gacgcuggcagcaggagguaaaugcucucugugcucucagggacaccuccucugauaugcuga

SEQ ID NO: 2766 - RNA, 62 nt, Homo sapiens
gacgugagacugacauaugccauuaucucuuuuccaguauuaaacacucauaugcuuauggc

SEQ ID NO: 2767 - RNA, 62 nt, Homo sapiens
gacuacaauaagacauuuugaggaggauauuuggcuacuguaaacauggcugguggaaaauc

SEQ ID NO: 2768 - RNA, 62 nt, Homo sapiens
gacuacaggaagggcagagaauacugacgguuaccaguauuaacccuucaucuguucuugaa

SEQ ID NO: 2769 - RNA, 63 nt, Homo sapiens
gacuacuuuuugacuucuguuugucuuacgcuucucucagggaaaaacaugcaguccucuagu

SEQ ID NO: 2770 - RNA, 63 nt, Homo sapiens
gacuaguaaauugucugccuccuauagcagaaaggugaauguacaaacuguugguggcccuga

SEQ ID NO: 2771 - RNA, 62 nt, Homo sapiens
gacuagucgagauuguauuuauauuuuccuguuacuacuguauaaagcuuaaaccuacuuaa

SEQ ID NO: 2772 - RNA, 63 nt, Homo sapiens
gacucagaggggagggaagggcucaucagcacccgcucagggagccugucccuuuauguuccc

SEQ ID NO: 2773 - RNA, 62 nt, Homo sapiens
gacugaacagaagagaaaaauuauuaauuagcugcuacuguauguugauucuuuucggagaa

SEQ ID NO: 2774 - RNA, 63 nt, Homo sapiens
gacugaugagaaacguucauaacaugaagguaagacucagggagacagagacuuuguggaagu

SEQ ID NO: 2775 - RNA, 64 nt, Homo sapiens
gacuuaccaaagguaauacucgugaguagguggcagauguagcaaaaacuucacaacaauucag

SEQ ID NO: 2776 - RNA, 62 nt, Homo sapiens
gacuugccaaacagucuuuuaugaaggaaaguuacaguauuaauuuuugaaaagguuuuuuu

SEQ ID NO: 2777 - RNA, 63 nt, Homo sapiens
gacuuucuccaauguggacucugugugucagugaaugaauguaguaaaauucacuuuggaagg

SEQ ID NO: 2778 - RNA, 61 nt, Homo sapiens
gacuuugaacuuaaauauauccccuuccucaaguggugcuauuuuaaaacuaaaaaaaacu

SEQ ID NO: 2779 - RNA, 62 nt, Homo sapiens
gagaaauguaguuugaaucauaaucuaaaucaucguaugauagaagagggaaaguuuuggug

SEQ ID NO: 2780 - RNA, 63 nt, Homo sapiens
gagaaauuuuaaaauaauagaagaaauagaaauuuugaauguauaaaagaaaaagaucaaguu

SEQ ID NO: 2781 - RNA, 63 nt, Homo sapiens
gagaagugauaaacaccuccagcuuucuaacauccuccccacaccaucucaccauauccaucu

SEQ ID NO: 2782 - RNA, 63 nt, Homo sapiens
gagacagcccacccccguguccaccgugaccccuguccccacacugaccuguguucccucccc

SEQ ID NO: 2783 - RNA, 61 nt, Homo sapiens
gagacagggaagagaagugcaagaauugguugcuggugcuacauggcggcagcuuugacau

SEQ ID NO: 2784 - RNA, 63 nt, Homo sapiens
gagagacccugcaagaccacggagggagcgacacuugaauguagaauaggcagggggcccugc

SEQ ID NO: 2785 - RNA, 61 nt, Homo sapiens
gagagcacuuugaaagauaacauuuuauuaugauggugcuagguaaaaaauuguaaagacu

SEQ ID NO: 2786 - RNA, 62 nt, Homo sapiens
gagaggaaagaacacuucccaacuuacucuaggucaguauuacccugauacuagacuagaca

SEQ ID NO: 2787 - RNA, 63 nt, Homo sapiens
gagagucagguaugugagcaucucugaagcaguguugaauguaauuuucggaaacauggauug

SEQ ID NO: 2788 - RNA, 63 nt, Homo sapiens
gagaugaacacugacuuuugcauauggucucuuaccucagggaagaucacuugcuagcaacuc

SEQ ID NO: 2789 - RNA, 62 nt, Homo sapiens
gagauuguaaaaguaaaaaacuguaaauguauauguaugauagaauuguuuccucuaagugu

SEQ ID NO: 2790 - RNA, 63 nt, Homo sapiens
gagcacauacgaacucacacuggagagaaaccuuaugaauguaaaguaugcggaaaggccuuc

SEQ ID NO: 2791 - RNA, 63 nt, Homo sapiens
gagcacgaaagaauucccacuggugagaaacaguaugaauguaaacauugugauuaagccuuc

SEQ ID NO: 2792 - RNA, 63 nt, Homo sapiens
gagcagacuggggggcuguugccccucccuccaucuccccacacccaccccaccccacagcag

SEQ ID NO: 2793 - RNA, 63 nt, Homo sapiens
gagcagcacuccauaucccuuacugucaccuucacuccccacacagcucaugagaugugugac

SEQ ID NO: 2794 - RNA, 63 nt, Homo sapiens
gagcagccccaggccagagaggccucccgguccagcucagggaugcuccugccagcacagggg

SEQ ID NO: 2795 - RNA, 62 nt, Homo sapiens
gagcauuucucauuagcccaguuaauccucacaccuacuguaggagauagguacuguuguuu

SEQ ID NO: 2796 - RNA, 62 nt, Homo sapiens
gagccacuguggcaucugaggaagacccaggguacaguauuagcauuucuuucaacccuaag

SEQ ID NO: 2797 - RNA, 63 nt, Homo sapiens
gagccaugugucuuuacaccucgcuguugucacaucucagggaacugacccucaggcacaccu

SEQ ID NO: 2798 - RNA, 63 nt, Homo sapiens
gagccucccucugacacagaggagguggcuccccuuccccacaccuuagaguggcugggaggg

SEQ ID NO: 2799 - RNA, 64 nt, Homo sapiens
gagccuugagaggaauguggcuguguggccugaguuauguagcaugcaacugcaacuucugcuu

SEQ ID NO: 2800 - RNA, 63 nt, Homo sapiens
gagcgcaucaccugaaugucgugaagaaguaucucugaauguauccaggagaggaacugcaua

SEQ ID NO: 2801 - RNA, 64 nt, Homo sapiens
gagcuagacuccaucuuuccaauaaaaaugagcccuauguagcacuagguuugaauucuaaaau

SEQ ID NO: 2802 - RNA, 61 nt, Homo sapiens
gagcucccgcccccacugggcccuccuuccuccuggugcuaauuuggggaccccaggggcc

SEQ ID NO: 2803 - RNA, 62 nt, Homo sapiens
gagcugagaguuuacaggcacugcagaagcuguucaguauuauauguguauaugcuauuuuu

SEQ ID NO: 2804 - RNA, 64 nt, Homo sapiens
gagcugugaaugcaccacggcacucaagccugggcaauguagcaagauccugucucuacaagaa

SEQ ID NO: 2805 - RNA, 62 nt, Homo sapiens
gagcuuuaaaaaucauuguauggauaguaaaauucuacuguauggaauacaauguaauuuug

SEQ ID NO: 2806 - RNA, 63 nt, Homo sapiens
gaggaagucagagucggccacuaaccagaugcaaauccccacacucuuccccuuagcgcuuga

SEQ ID NO: 2807 - RNA, 63 nt, Homo sapiens
gaggacacggaggguucagaccccuccucagacccuccccacaucugaaacugccucccccca

SEQ ID NO: 2808 - RNA, 63 nt, Homo sapiens
gaggacagcugccuguuuccuccccaucagccuccuccccacauccccagcugccuggcuggg

SEQ ID NO: 2809 - RNA, 63 nt, Homo sapiens
gaggaggccggggcucccaggaagcggacgcccgguccccacacagcgccgcggccgccccuc

SEQ ID NO: 2810 - RNA, 63 nt, Homo sapiens
gaggaggcugcagaagcaauggagugaaccucugcuccccacacagcuggcuacacugcucag

SEQ ID NO: 2811 - RNA, 64 nt, Homo sapiens
gaggcacgggccaucuguggagguacggagucuugcauguagcaagcuuucugugcugacggca

SEQ ID NO: 2812 - RNA, 64 nt, Homo sapiens
gaggcaggacuuuccagaaaucgacccucuaagucaauguagcacauuuucccccaaccccacc

SEQ ID NO: 2813 - RNA, 63 nt, Homo sapiens
gaggccccuccaggccaggguccuggggcaggcaucucagggagcagccagcccaggccuccu

SEQ ID NO: 2814 - RNA, 63 nt, Homo sapiens
gaggccgucucagcucccagcccuuccccccagcccucagggagcuccgcucagccccggcgg

SEQ ID NO: 2815 - RNA, 62 nt, Homo sapiens
gaggcuuagaauuucaaccacgugucaggucagacaguauuauaaacuguacuuugcugucu

SEQ ID NO: 2816 - RNA, 62 nt, Homo sapiens
gagggagguggaggagcugggcugcuuuucccagcaguauuagugucccccaggacagggga

SEQ ID NO: 2817 - RNA, 62 nt, Homo sapiens
gagggaugcugaccacagaccuuuauagcagcccguaugauauuauucacauuaugauaugu

SEQ ID NO: 2818 - RNA, 63 nt, Homo sapiens
gaggggcaaaaauauuuugcaagcucuggaauuguugaauguauucuuuuauauaacuacauu

SEQ ID NO: 2819 - RNA, 63 nt, Homo sapiens
gaggggggcuucagaagggggggaacaccccagaucucagggaaccccgcccccugccuuucc

SEQ ID NO: 2820 - RNA, 63 nt, Homo sapiens
gaggguaaauggagaaaauauuucugggauuacaaugaauguaagcccaaauuguggaauugc

SEQ ID NO: 2821 - RNA, 64 nt, Homo sapiens
gagguagcagacagaugugaagcaguggugaaggccauguagcaaguggggaaauacauccaaa

SEQ ID NO: 2822 - RNA, 62 nt, Homo sapiens
gagguggagacugcagugagccaagauugugccacuacuguacucuagccugggcagcagag

SEQ ID NO: 2823 - RNA, 63 nt, Homo sapiens
gagguggcagcucugaccaccucuggccccaggcccucagggagaaaggagcaacacacugcc

SEQ ID NO: 2824 - RNA, 64 nt, Homo sapiens
gaggugggagaaucgagauacucagccagccuggcaauguagcaaagacuccaucucaaaaaaa

SEQ ID NO: 2825 - RNA, 64 nt, Homo sapiens
gaguaacccuagaagacuugaaauauaaucuuuuauauguagcauucacuucccucuuacugug

SEQ ID NO: 2826 - RNA, 62 nt, Homo sapiens
gaguaggguuaagguucucagugacacaagaauucaguauuaaguacauagguauuuacuau

SEQ ID NO: 2827 - RNA, 62 nt, Homo sapiens
gaguauuuucaagaaaagaauaaaaacauuaaugcaguauuagguuaacuggauaucaacua

SEQ ID NO: 2828 - RNA, 63 nt, Homo sapiens
gagucaaugugcaguguagcccacacuugagaggaugaauguaugugcacugucacuuugcuc

SEQ ID NO: 2829 - RNA, 61 nt, Homo sapiens
gaguccagcugcagccacguggccaucuggagcuggugcuauaggugaccaucugguacau

SEQ ID NO: 2830 - RNA, 61 nt, Homo sapiens
gagucucaaucuguuacccaggcuggagugcaguggugcuaucuuggcucacugcaaaccc

SEQ ID NO: 2831 - RNA, 61 nt, Homo sapiens
gagucucacucuguugcucuggcuggagugcaguggugcuaucucagcucacugcaagcuc

SEQ ID NO: 2832 - RNA, 61 nt, Homo sapiens
gagucucacuuugucacccaugcuggaguauaguggugcuaucucggcucacugcaaccau

SEQ ID NO: 2833 - RNA, 62 nt, Homo sapiens
gagucucucagccuuugcuuacugguguuuccgacaguauuaacccagugcguggcaugucu

SEQ ID NO: 2834 - RNA, 63 nt, Homo sapiens
gagucuuaucguuguacugauagaagggucagauauccccacauggaguugagugggagaaag

SEQ ID NO: 2835 - RNA, 61 nt, Homo sapiens
gaguggcccuguuuucuguguuaaaaccccauuuggugcuauugaguuuguucuuuauucu

SEQ ID NO: 2836 - RNA, 64 nt, Homo sapiens
gagugggaaaacacugccaucuuaguuuggauucuuauguagcaggaaauaaaguauagguuua

SEQ ID NO: 2837 - RNA, 62 nt, Homo sapiens
gaguuccacuguggauuacaguuuguauggacuacuacuguaaauuauagcuuguuuggagg

SEQ ID NO: 2838 - RNA, 53 nt, Homo sapiens
gaguucggcccccucuugacccugccucagggaggaucuggagucugucucaa

SEQ ID NO: 2839 - RNA, 62 nt, Homo sapiens
gaguuuauagaaagaugcugauugguaggugaugguaugauaucaaacuauuuugcaguugu

SEQ ID NO: 2840 - RNA, 63 nt, Homo sapiens
gaguuugaagguucucggaaagaccggagggcuucuccccacagaaggcggagagagcugggg

SEQ ID NO: 2841 - RNA, 62 nt, Homo sapiens
gauaaacuuugaauuaaauacaguugucuugaggguaugauaaguccacaaaaaauuggaaa

SEQ ID NO: 2842 - RNA, 63 nt, Homo sapiens
gauaagaauaauucagguagcaucugaaauuuuaaugaauguauaauuggcauaucauggaaa

SEQ ID NO: 2843 - RNA, 62 nt, Homo sapiens
gauaaguguuuguguucagaagauguuguuuugccaguauuagaaaauacugugagccgggc

SEQ ID NO: 2844 - RNA, 62 nt, Homo sapiens
gauacaguaaauuuuuagaaaaaaauaccauuuacaguauuauugugaaccauuuaacccuu

SEQ ID NO: 2845 - RNA, 62 nt, Homo sapiens
gauacgugcaguaucuuuaaugaguaucuucaugguaugauaguguguguuugugagugcga

SEQ ID NO: 2846 - RNA, 63 nt, Homo sapiens
gauacuuguacgaaacacauuggagauagacccugugaauguaagcacuugguaaagccuuaa

SEQ ID NO: 2847 - RNA, 62 nt, Homo sapiens
gauauaauaaaagguguuuaucauaaaaaagaaacaguauuagauuuuggucuccauaaucu

SEQ ID NO: 2848 - RNA, 62 nt, Homo sapiens
gauauagagaaaucuggcuggcuacaguguagaucaguauuaggaauauuucuaaagauccu

SEQ ID NO: 2849 - RNA, 64 nt, Homo sapiens
gauauuguauuguucgucauuauaauaugcuaccacauguagcaauaauuacaauauuuuauua

SEQ ID NO: 2850 - RNA, 61 nt, Homo sapiens
gaucaaguguggcuguaggccuuuguuuuccaauggugcuauauucuguuuucaaacacuu

SEQ ID NO: 2851 - RNA, 62 nt, Homo sapiens
gaucccauuuagccccugaacauaauaccaucugcaguauuauaaaagucauuuagaagguc

SEQ ID NO: 2852 - RNA, 64 nt, Homo sapiens
gauccuggguggguuucuguggcacucuuuuagaacauguagcaucaucuuagaggucuauuuu

SEQ ID NO: 2853 - RNA, 63 nt, Homo sapiens
gaucuuaaaacccaaaguacgagaaauguuucuguugaauguaaugcuacaugaaugcuugau

SEQ ID NO: 2854 - RNA, 62 nt, Homo sapiens
gaugaacuggugcagugccugacagaauaaagaacaguauuaaucccuuugagaaagcauag

SEQ ID NO: 2855 - RNA, 63 nt, Homo sapiens
gaugaacuguauuuugcauuuugucuacuuguaagugaauguaacauacugucaauuuuccuu

SEQ ID NO: 2856 - RNA, 63 nt, Homo sapiens
gaugagcucaacagucucagcccuagaggaauagacucagggauuucaccaggucggugcagu

SEQ ID NO: 2857 - RNA, 63 nt, Homo sapiens
gaugcccugggaagauccuuggcugccgcuuucucuccccacagccucaaggccacccuaccg

SEQ ID NO: 2858 - RNA, 63 nt, Homo sapiens
gaugcucauuguucccaucuugaugaaacuugagucucagggaagugaagugacuugcccagg

SEQ ID NO: 2859 - RNA, 63 nt, Homo sapiens
gaugguuacacuguuagaacacuauuuucagaaucugaauguaauuuguguaauaaaguguuu

SEQ ID NO: 2860 - RNA, 64 nt, Homo sapiens
gaugguuaugucaaagucauaguucauccuauccagauguagcauucaugguaaacuuuuaagu

SEQ ID NO: 2861 - RNA, 62 nt, Homo sapiens
gauguauguguaaaucgauuagcuauuuauccaacuacuguauauuuagguaacuagaauuu

SEQ ID NO: 2862 - RNA, 63 nt, Homo sapiens
gaugugauagugccgugaauguauucuacuggaaaugaauguaauaauacauuaaauuuuuaa

SEQ ID NO: 2863 - RNA, 63 nt, Homo sapiens
gauguuucugcaucaugucuaccagggagcaggguuccccacaguuucagaggugguccagga

SEQ ID NO: 2864 - RNA, 62 nt, Homo sapiens
gauguuuguguaugugggaguacucucaucacuacaguauuacucuuacaagaguggacuca

SEQ ID NO: 2865 - RNA, 62 nt, Homo sapiens
gauucacuuuguguguguuagugcucuaaaguagcaguauuauuauuaaacuguccccagag

SEQ ID NO: 2866 - RNA, 64 nt, Homo sapiens
gauucuaaucuuuucaugcugcacacgauuccuuuaauguagcauccuuaucugaaagaaauaa

SEQ ID NO: 2867 - RNA, 63 nt, Homo sapiens
gauucuuaauguaugauuucuuuguucauauauuaugaauguauuauuuuauuugcuucguaa

SEQ ID NO: 2868 - RNA, 63 nt, Homo sapiens
gauucuuuuccaaauaucaaaacuccuggcaguuccucagggacaggcucugagcagcaguga

SEQ ID NO: 2869 - RNA, 62 nt, Homo sapiens
gauugaauguagacagggauaugcguauaguuuucaguauuaguucuagauaacacuaaauu

SEQ ID NO: 2870 - RNA, 62 nt, Homo sapiens
gauugauauuuuguguauugaacaggaagacugccaguauuaaaaaaauccuucugggaauc

SEQ ID NO: 2871 - RNA, 62 nt, Homo sapiens
gauuuaaaacuaauuauagucuucuuuaauuuuucuacuguauacauuucaucuaguuuuca

SEQ ID NO: 2872 - RNA, 63 nt, Homo sapiens
gauuucaacccaggugccccuggccuggccagcagugaauguaggagaugaauugugcaagug

SEQ ID NO: 2873 - RNA, 63 nt, Homo sapiens
gauuucauugagggcaaggcugguggcagguacuaugaauguaauucauaauuuaaaaggaaa

SEQ ID NO: 2874 - RNA, 63 nt, Homo sapiens
gauuucuccaauguguccugacaggucagcccugcuccccacagggccaggcuggcaggggcc

SEQ ID NO: 2875 - RNA, 63 nt, Homo sapiens
gauuuuaauaugaaugaaguuugcaagcaucccuuugaauguagaaacugcuaacaugcuguu

SEQ ID NO: 2876 - RNA, 62 nt, Homo sapiens
gauuuuuugcuuguuuguuuguuuuguacuaaaacaguauuaucuuuugaauaucguaggga

SEQ ID NO: 2877 - RNA, 62 nt, Homo sapiens
gcaaaauguuuuuuauuacggcuuuucuauugcuguaugauacagaacucuuuuggcauaaa

SEQ ID NO: 2878 - RNA, 62 nt, Homo sapiens
gcaaacuagccaacagguacugucuuugaauuuacuacuguaagacuaagcaguguuacugg

SEQ ID NO: 2879 - RNA, 63 nt, Homo sapiens
gcaaaggcaaaacaagcccugauaagcaaaagcaguccccacagccacagccuggcagcucug

SEQ ID NO: 2880 - RNA, 64 nt, Homo sapiens
gcaaauuuuauaaugaaguuuuaaguugaaaauaaaauguagcaacauuuugauccucuucugg

SEQ ID NO: 2881 - RNA, 63 nt, Homo sapiens
gcaacucugacagcaagcagaaacugaaugacugacucagggaggugucaccauccgaaggga

SEQ ID NO: 2882 - RNA, 61 nt, Homo sapiens
gcaagaaguggggccucgagcugucagucaucauggugcuauccucugaaccccucagcug

SEQ ID NO: 2883 - RNA, 63 nt, Homo sapiens
gcaaggaaagaaccaggagggagagugcagccaggcucagggauccccggacaccucugucca

SEQ ID NO: 2884 - RNA, 63 nt, Homo sapiens
gcaaggaggagagauguacgugggcuguguggcaguccccacacccugcccuggcuucuucag

SEQ ID NO: 2885 - RNA, 62 nt, Homo sapiens
gcaagguuuaggcugguggcccaggaccaucauccuacuguaauaaagaugauugugaaaua

SEQ ID NO: 2886 - RNA, 62 nt, Homo sapiens
gcaaguggauaugagcuccucauagaaaccagaccuacuguauuagacaguaaccucuaacc

SEQ ID NO: 2887 - RNA, 62 nt, Homo sapiens
gcaauaaugcacuuuucauacuugaaauuuauuuguaugauauaaaguuauuacuuuaaaca

SEQ ID NO: 2888 - RNA, 62 nt, Homo sapiens
gcaauaauuugagggcaaacuuaguagugaguguguaugauagaaucaagagaauuauggga

SEQ ID NO: 2889 - RNA, 64 nt, Homo sapiens
gcaauuucagcagaguuaauuugcuugcuguuagagauguagcacuuuauccuuccuaucagua

SEQ ID NO: 2890 - RNA, 63 nt, Homo sapiens
gcacaccuagccugcuugcuuacugcuuauauuugcucagggaagaguaggaaaauaaaauau

SEQ ID NO: 2891 - RNA, 63 nt, Homo sapiens
gcacaccuuccaggcuggauuuuuaaugaaacagacucagggagguaggggcuggcagggacc

SEQ ID NO: 2892 - RNA, 63 nt, Homo sapiens
gcacacgaauccauccaccuguccacgugcacacgugaauguagcgauagauauuuggacauc

SEQ ID NO: 2893 - RNA, 63 nt, Homo sapiens
gcacagaaugagcuucgagcuuuguucagacuaaaugaauguaucugggaggggucgggggca

SEQ ID NO: 2894 - RNA, 62 nt, Homo sapiens
gcacaguugucccauugaauuauuugagcaaaaacuacuguaaauaacuuuuuugucuuuug

SEQ ID NO: 2895 - RNA, 63 nt, Homo sapiens
gcacauccuagcaggcagccccuggcgccugcugccucagggaugcuccaaccacccucguuc

SEQ ID NO: 2896 - RNA, 63 nt, Homo sapiens
gcacaugaaagaacucacacuggagaaaaacccuaugaauguaaaaaaugugggaaaguguuc

SEQ ID NO: 2897 - RNA, 63 nt, Homo sapiens
gcacaugaaaggaaucacacuguacagaaacgcuaugaauguaaacaauguggaaaaaccuac

SEQ ID NO: 2898 - RNA, 63 nt, Homo sapiens
gcaccaugaaauuaaaaucaucucauuccugaagaugaauguaggaccagacauuuuagcuuc

SEQ ID NO: 2899 - RNA, 63 nt, Homo sapiens
gcacccagcugggcgcagccuuggggccugcggucugaauguaucccuccccucaguuuuaac

SEQ ID NO: 2900 - RNA, 63 nt, Homo sapiens
gcaccccacgcccuguucacgcucacccagucaccuccccacaucgcacacuggggccccggg

SEQ ID NO: 2901 - RNA, 63 nt, Homo sapiens
gcacccccaggcuucaaaccaccuggaaugcacagcucagggaagcugguggaugccuagagg

SEQ ID NO: 2902 - RNA, 63 nt, Homo sapiens
gcacccccggacgccccccggccugauggccaggccucagggaccaaggagauggggagggcg

SEQ ID NO: 2903 - RNA, 64 nt, Homo sapiens
gcaccugguaccuggauuggaguucucacucuguucauguagcagaugaaaaaaaucaaagcac

SEQ ID NO: 2904 - RNA, 63 nt, Homo sapiens
gcacggcugcaaagacgcccaccugucuuauuggauccccacaggaauagacccaccaggcgg

SEQ ID NO: 2905 - RNA, 63 nt, Homo sapiens
gcacuaaccuccgaagccagacucuguuaugugugcucagggaguguggagcggcugguggag

SEQ ID NO: 2906 - RNA, 62 nt, Homo sapiens
gcacuagacuuuucuauuggccugugccaucgcccaguauuagcacaaguuagggaggaaga

SEQ ID NO: 2907 - RNA, 63 nt, Homo sapiens
gcacugcauggucuagggacguucucucuccaguccucagggaagaggaccccaggacuucgc

SEQ ID NO: 2908 - RNA, 63 nt, Homo sapiens
gcagaacacauuuuuguacugccucucuuaaaugcugaauguaacuguuauguauaaauccau

SEQ ID NO: 2909 - RNA, 62 nt, Homo sapiens
gcagaauuaacagaccucuucuccucaugguacacaguauuacaguguugaaguaaugguga

SEQ ID NO: 2910 - RNA, 63 nt, Homo sapiens
gcagaccuggugcugcaaaggaaagggccugaggccucagggagccccguggagggaugacag

SEQ ID NO: 2911 - RNA, 63 nt, Homo sapiens
gcagcaugugcaggccuggaagagcaaagccaaaucucagggaaguccuugguugauguaucu

SEQ ID NO: 2912 - RNA, 63 nt, Homo sapiens
gcagcucugaggcagagaccucugcccuccucacccucagggacaccacucggcuccaugggg

SEQ ID NO: 2913 - RNA, 64 nt, Homo sapiens
gcaggaguccuuccugguagccagcucagaauacccauguagcagcaacuugaacgaaugucac

SEQ ID NO: 2914 - RNA, 61 nt, Homo sapiens
gcaggggcaagcaggagcuagcagccgccuacuuggugcuaaccccucgauguacauagcu

SEQ ID NO: 2915 - RNA, 63 nt, Homo sapiens
gcaggggugacguauguagaaugcuuaggguguccuccccacagagcagauacuugaaccgac

SEQ ID NO: 2916 - RNA, 63 nt, Homo sapiens
gcagguaaauugucgggggagagaguuagcauguaugaauguaaggaugagggaagcgaagca

SEQ ID NO: 2917 - RNA, 64 nt, Homo sapiens
gcauaagaaaauucacaccagagccaaaucuuacaaauguagcaguugugaaagagucuucagu

SEQ ID NO: 2918 - RNA, 62 nt, Homo sapiens
gcauaagcuaucaccuagcagccucaaaacgggucaguauuaagguuuucaaccggaaggag

SEQ ID NO: 2919 - RNA, 62 nt, Homo sapiens
gcauaagugguuuucuucaggaaaauaaauaucacaguauuaucuguguuaaaaugguuuuu

SEQ ID NO: 2920 - RNA, 64 nt, Homo sapiens
gcauacuuugauggagcuuaauugugugaguagaauauguagcaaagcuuuuuaggauuuucag

SEQ ID NO: 2921 - RNA, 63 nt, Homo sapiens
gcaucccccagccccaagccugcgcgcaucugucacucagggacuuucuaugggucuuugugg

SEQ ID NO: 2922 - RNA, 63 nt, Homo sapiens
gcauccccccacccuacaacugagcacaaccucuuuccccacagugcaauucagaauaugcuc

SEQ ID NO: 2923 - RNA, 62 nt, Homo sapiens
gcauccgcugggggcgcuguucuuuagcuagugccaguauuaaaacauugucauuacgagag

SEQ ID NO: 2924 - RNA, 63 nt, Homo sapiens
gcauccucugggaucuucugagguggacagcacuuugaauguagcauuucacuggaacagagu

SEQ ID NO: 2925 - RNA, 63 nt, Homo sapiens
gcaucuuuccaguggggcccccauucacguugguccucagggaaaccagggucccgggcaggc

SEQ ID NO: 2926 - RNA, 63 nt, Homo sapiens
gcaugaacauuacugcagguuuuugaugaauauaaugaauguauggaauucaauugaauuugc

SEQ ID NO: 2927 - RNA, 63 nt, Homo sapiens
gcauggagaaugggugcaaaaagcugacuucuguauccccacacuuggauuaggguuucccuc

SEQ ID NO: 2928 - RNA, 63 nt, Homo sapiens
gcauggcaccugucgcccagugcccuggggcugaucucagggaagcccagcuccagggccaga

SEQ ID NO: 2929 - RNA, 62 nt, Homo sapiens
gcauuacagguuuuuguagguuauagauacccagguaugauaaaauagguugcccuuuauau

SEQ ID NO: 2930 - RNA, 63 nt, Homo sapiens
gcauucaguggccuaucuccagauugucugauuucugaauguaaaguuguuguguuuuuuuuu

SEQ ID NO: 2931 - RNA, 64 nt, Homo sapiens
gcauugaaauagcauuucuuugggauugugaauagaauguagcaaaaccagauuccaguguacu

SEQ ID NO: 2932 - RNA, 62 nt, Homo sapiens
gcauuggggacaguuuuuauaagugggaaggacucaguauuauuauauuugagaugauaagc

SEQ ID NO: 2933 - RNA, 63 nt, Homo sapiens
gccaauugauccucuacuuuccuucuuuagucccucucagggacgccuccauccccggcuccc

SEQ ID NO: 2934 - RNA, 62 nt, Homo sapiens
gccacacugcucucuuccuuccagaagcuugguucuacuguaagcaacagcuccuucauggg

SEQ ID NO: 2935 - RNA, 63 nt, Homo sapiens
gccacccaaccuaaauguacuuaucuguccccauguccccacaccagccuguuuucauaauaa

SEQ ID NO: 2936 - RNA, 63 nt, Homo sapiens
gccacuagccacacccucacucugccccacauccucucagggaaagcccaaacccccuaucac

SEQ ID NO: 2937 - RNA, 63 nt, Homo sapiens
gccacuuggaguccccugcaccgugccacuuuccauccccacaccauugccugcuccucccau

SEQ ID NO: 2938 - RNA, 63 nt, Homo sapiens
gccagacacuaggagaauuauuaacuucucauacuuccccacauugagaagcauucggagugu

SEQ ID NO: 2939 - RNA, 63 nt, Homo sapiens
gccagagucguaauugaaaucuaggaagucucgcuugaauguaugcgauacauauuuucacua

SEQ ID NO: 2940 - RNA, 63 nt, Homo sapiens
gccagccuggaggaggaaagggagccugcucucccuccccacaccccacccaaagcauacacc

SEQ ID NO: 2941 - RNA, 55 nt, Homo sapiens
gccagcucugggggccuaaggcaggagcucagggacauggagaccguggagagga

SEQ ID NO: 2942 - RNA, 63 nt, Homo sapiens
gccaggagagguagagugaaaaucccagccauggaugaauguacuaauuugaaagccaagugu

SEQ ID NO: 2943 - RNA, 63 nt, Homo sapiens
gccaggauccccuuagcaggguccuucccaccagacucagggaagggaugccccauuaaagug

SEQ ID NO: 2944 - RNA, 63 nt, Homo sapiens
gccaguucaaaagaauaguagaugugauagugccgugaauguauucuacuggaaaugaaugua

SEQ ID NO: 2945 - RNA, 62 nt, Homo sapiens
gccauauaauguuagcuggaaggucaauuucaguguaugauauacuuuauuaagauguauaa

SEQ ID NO: 2946 - RNA, 63 nt, Homo sapiens
gcccaaaguugugcagagcgcuggggacuccagacuccccacagcagcagagacucgggacug

SEQ ID NO: 2947 - RNA, 63 nt, Homo sapiens
gcccacaccaccugcgcaugccuggcacaccccucuccccacagagccucugcuugggucuau

SEQ ID NO: 2948 - RNA, 64 nt, Homo sapiens
gcccagaggggaacuugauucaaaaauuugggauucauguagcagagacagagcuagacuguaa

SEQ ID NO: 2949 - RNA, 63 nt, Homo sapiens
gcccaggaaaauaacagagcuggaugcugagagaccucagggauggcccagcugaucuaagga

SEQ ID NO: 2950 - RNA, 63 nt, Homo sapiens
gcccaggcuagucuuuucuuucuucuuuuuuuuuuuccccacaguauauauuauacagcaguc

SEQ ID NO: 2951 - RNA, 64 nt, Homo sapiens
gcccagugucucuucuagccccuccaacaguucuucauguagcacugcuuuuggacagugaccc

SEQ ID NO: 2952 - RNA, 63 nt, Homo sapiens
gcccaucgugccugccgccccuucaggucccgaccuccccacaauaaaaugugauuggaucgu

SEQ ID NO: 2953 - RNA, 63 nt, Homo sapiens
gccccacguggcuucagauaggucccagcuucucccucagggacaggccccugucccucaguu

SEQ ID NO: 2954 - RNA, 64 nt, Homo sapiens
gccccaucccacaccuguuucaaauccuugaaaugcauguagcaguuguugggcgaaugguguu

SEQ ID NO: 2955 - RNA, 63 nt, Homo sapiens
gcccccagcugccuccucacaucugcccuggggacuccccacacuccggggcagaucuuuccu

SEQ ID NO: 2956 - RNA, 63 nt, Homo sapiens
gccccuucaggaaggaccccccaaagcugaggggcugaauguagccuuuucaacagagaaggc

SEQ ID NO: 2957 - RNA, 63 nt, Homo sapiens
gcccuacacucagcucaugccuaaccuauguguggcucagggaccagcuuggggaaggaaagg

SEQ ID NO: 2958 - RNA, 62 nt, Homo sapiens
gcccuacucuccauaccccguguacucaaauucucuacuguaugaauuaugcuuuaaguaga

SEQ ID NO: 2959 - RNA, 63 nt, Homo sapiens
gcccucggaucagggccgggaugggaggggucagccucagggagcagcugccuugggggacac

SEQ ID NO: 2960 - RNA, 63 nt, Homo sapiens
gcccucucgcuucuaacacagggcaccugcuggggcucagggauguuagggacgaguuccagc

SEQ ID NO: 2961 - RNA, 62 nt, Homo sapiens
gcccuggauggcccuagggcagugggcccaugagcaguauuagucuaaaggggucggaacug

SEQ ID NO: 2962 - RNA, 61 nt, Homo sapiens
gcccuguugccgagcccagcugugggcggcuccuggugcuaacaacaaaguuccacuucca

SEQ ID NO: 2963 - RNA, 63 nt, Homo sapiens
gccgagugauagagcagaaggagguucccaaugggcucagggacgaagcuuguggcaaggaaa

SEQ ID NO: 2964 - RNA, 63 nt, Homo sapiens
gccgauccuuuguccagaagaagcccauggaauauugaauguaauacauuuagucaauuaaau

SEQ ID NO: 2965 - RNA, 63 nt, Homo sapiens
gccgcugugugucuuagcauggaaauaaauaaaccugaauguacgugcucgccuuaagcaggg

SEQ ID NO: 2966 - RNA, 61 nt, Homo sapiens
gccgggcgcaggaacuguguguguccuacacaauggugcuauucugugucaaacaccucug

SEQ ID NO: 2967 - RNA, 61 nt, Homo sapiens
gccguuuauucagguggggcugaccaugggauauggugcuaaugauauauauuacauuuac

SEQ ID NO: 2968 - RNA, 61 nt, Homo sapiens
gccguuuauucagguggggcugaccaugggauguggugcuaaugauaaauauuacauuuac

SEQ ID NO: 2969 - RNA, 63 nt, Homo sapiens
gccuaaaaugugaaagcauauuuuguauccuaaaaugaauguaugauauucuaaacaucuguu

SEQ ID NO: 2970 - RNA, 62 nt, Homo sapiens
gccuaaaguggcauuauugacugcuggugugaugcuacuguaauguaauaaauuauuaaguu

SEQ ID NO: 2971 - RNA, 63 nt, Homo sapiens
gccuaagaaauacugaggcuuccugcuccucugcucucagggaaacugggcugugagccacac

SEQ ID NO: 2972 - RNA, 63 nt, Homo sapiens
gccuacacucguccugccugcaagccucccguugguccccacagcagcagugccucgguuccu

SEQ ID NO: 2973 - RNA, 63 nt, Homo sapiens
gccucaaggggcccagccacgucaaacuucucucccucagggacucuccagcaccaaaaggca

SEQ ID NO: 2974 - RNA, 61 nt, Homo sapiens
gccucauccccaggacccccuuggcucagaguguggugcuagaaacuggcccccagcccag

SEQ ID NO: 2975 - RNA, 61 nt, Homo sapiens
gccucccuuaccccccagcuuucuuucuacagauggugcuacucuuggucucccacaggaa

SEQ ID NO: 2976 - RNA, 63 nt, Homo sapiens
gccucucugccccuauggggcucuguccugcaccccucagggauggcgacagcaggccagaca

SEQ ID NO: 2977 - RNA, 62 nt, Homo sapiens
gccucugacaugagggacaugugacagugucauucaguauuauguucaaaagacauuuuuau

SEQ ID NO: 2978 - RNA, 63 nt, Homo sapiens
gccucugccuccaggagggcaucagcuuucccuggcucagggaucuucucccuccccucaccc

SEQ ID NO: 2979 - RNA, 62 nt, Homo sapiens
gccugaaagauacaggggaucauguuaaaaauagcaguauuauuuuucgucucaaugguauu

SEQ ID NO: 2980 - RNA, 63 nt, Homo sapiens
gccugaucacugugugccacaccccaucacauccauccccacaagaaugccaggaggaggggu

SEQ ID NO: 2981 - RNA, 63 nt, Homo sapiens
gccuggacacguccuacuuaagaaaaugccuuuuacucagggaaucuccugcuacuuaaugug

SEQ ID NO: 2982 - RNA, 62 nt, Homo sapiens
gccuggacauccugaaggagaaguggucugccccguaugauaucaggaccauccugcucucu

SEQ ID NO: 2983 - RNA, 61 nt, Homo sapiens
gccuggaugccgaggaagcugcuggaugcuuaauggugcuagaggcucaaguguguuugaa

SEQ ID NO: 2984 - RNA, 61 nt, Homo sapiens
gccuggccucugucuguuugccauggagccugguggugcuaacggcccuuuccccaggaau

SEQ ID NO: 2985 - RNA, 63 nt, Homo sapiens
gccuguacauccaucccaggacacagcccagccccuccccacaccauacaagguaucagaaaa

SEQ ID NO: 2986 - RNA, 63 nt, Homo sapiens
gccugugccagcucccuucccuccccguuguccuguccccacagccauucugggagcugggga

SEQ ID NO: 2987 - RNA, 64 nt, Homo sapiens
gccuuaacuuacugaacugaacuuucugaaaacguaauguagcaguaucaauauacuuuugggc

SEQ ID NO: 2988 - RNA, 63 nt, Homo sapiens
gccuuaaugaagcucucaaaauauuuuaggagcugcucagggaguguuggguggaacuguuug

SEQ ID NO: 2989 - RNA, 63 nt, Homo sapiens
gccuugacccacaggacgugugguggcgccuggcacucagggacccccagcugccgcagcccu

SEQ ID NO: 2990 - RNA, 62 nt, Homo sapiens
gccuuuggggaaaauuaacuuuuucuuuugauaaguaugauauucaauaaaauuuucuaaau

SEQ ID NO: 2991 - RNA, 62 nt, Homo sapiens
gccuuuucauuaaaaauacaauuucaucuacucccuacuguaccuuucacugaugucaagug

SEQ ID NO: 2992 - RNA, 63 nt, Homo sapiens
gcgcccuccagagcugcggugucucccugccucauuccccacaucccacugagcaugggacca

SEQ ID NO: 2993 - RNA, 63 nt, Homo sapiens
gcgcgcccccucugcaauguaugccccuugccccuuccccacacuaauaauuuauauauauaa

SEQ ID NO: 2994 - RNA, 62 nt, Homo sapiens
gcggaaagaguuuaagugucuaacaaacuuaaagcuacuguaguaccuaaaaagucaguguu

SEQ ID NO: 2995 - RNA, 63 nt, Homo sapiens
gcggaagucagggcggcuggauuccaggacaggagugaauguaaaaauaaauaucgcuuagaa

SEQ ID NO: 2996 - RNA, 63 nt, Homo sapiens
gcggagaagccugccuggugcccacagccgucuggcucagggacuccacccuggccccgaguc

SEQ ID NO: 2997 - RNA, 63 nt, Homo sapiens
gcggggcagcguggccccaccggacuagcacaugaugaauguaaaguuggcacaaugaaaaug

SEQ ID NO: 2998 - RNA, 63 nt, Homo sapiens
gcggggggcagcggggggucucccuccggaccuaccucagggagcugagcgugcaggcgcucc

SEQ ID NO: 2999 - RNA, 63 nt, Homo sapiens
gcgggguugcccaccaguugcgaaagcccccuuuccucagggagcacgcgggaccucggugga

SEQ ID NO: 3000 - RNA, 62 nt, Homo sapiens
gcguguuuauuuuuguauuuuucucugguugggaguaugauaugaaggaucaagauccucaa

SEQ ID NO: 3001 - RNA, 63 nt, Homo sapiens
gcguucuggcuaacacuguuggaccugacccacacugaauguagucuuucaguacgagacaaa

SEQ ID NO: 3002 - RNA, 64 nt, Homo sapiens
gcguuuuauaauagcuuuuucccuucuguucuguucauguagcacagauaagcauugcacuugg

SEQ ID NO: 3003 - RNA, 61 nt, Homo sapiens
gcuaaaaagguauuauuauuuuuccuuuaaugauggugcuaaaauucuuccuauaaaauuc

SEQ ID NO: 3004 - RNA, 62 nt, Homo sapiens
gcuaaauuaauuacaauuaugaauggaggauauucuacuguacuuuuuuaaaaagaaacuau

SEQ ID NO: 3005 - RNA, 61 nt, Homo sapiens
gcuacccccgcugcccccuccacaguuccugaauggugcuaaggaucugcagcaguuggca

SEQ ID NO: 3006 - RNA, 63 nt, Homo sapiens
gcuacgcucugugcacgaagucaagaaccaaacagcucagggacccucuugccccuucaccau

SEQ ID NO: 3007 - RNA, 62 nt, Homo sapiens
gcuauucugacagaaaagacaaagguuacuaauuguaugauaguguuuuuauauggaagaau

SEQ ID NO: 3008 - RNA, 63 nt, Homo sapiens
gcuauuuuuuuguuuuguuuuuuguuuugagugaaugaauguacaggucauacuccaugugcc

SEQ ID NO: 3009 - RNA, 63 nt, Homo sapiens
gcucccauguccccaagaccucuggaguuuccucuugaauguacaugaaccacuguaauagca

SEQ ID NO: 3010 - RNA, 63 nt, Homo sapiens
gcucccuauacuuuucugucuuccagguucuacccuccccacagaccuaagcugcucccaguc

SEQ ID NO: 3011 - RNA, 63 nt, Homo sapiens
gcucugagcucuccucccaucuguccccaucuuccuccccacaccuacccacccagugggccc

SEQ ID NO: 3012 - RNA, 61 nt, Homo sapiens
gcucuguuuugucagagaguggccuauccagauuggugcuaugggggggucugaccccucc

SEQ ID NO: 3013 - RNA, 61 nt, Homo sapiens
gcugaaaggaaaaaaaguagaagccugacuacuuggugcuaacuacuaaagauuuuggcag

SEQ ID NO: 3014 - RNA, 63 nt, Homo sapiens
gcugaaaucagccauagcaguugacaaaacagcuauccccacaagugaugagauagucccuuu

SEQ ID NO: 3015 - RNA, 49 nt, Homo sapiens
gcugaacgacuacgugugagguccccacagccugcuucuccccugggcu

SEQ ID NO: 3016 - RNA, 63 nt, Homo sapiens
gcugagaagggacguuuccaucauucacagugcccuccccacagcacuaccucaccccgaccc

SEQ ID NO: 3017 - RNA, 62 nt, Homo sapiens
gcugagcaucaggaccuugccucgaauugucuuccaguauuacggugccucuucucugcccc

SEQ ID NO: 3018 - RNA, 62 nt, Homo sapiens
gcugcaagcaaggggcuagaaguucaccuccugacaguauuauuaauacuaugcaaauaugg

SEQ ID NO: 3019 - RNA, 62 nt, Homo sapiens
gcugcaguggguaguucuaaggauggaaaggugacaguauuacucucgagaggcaauucagu

SEQ ID NO: 3020 - RNA, 63 nt, Homo sapiens
gcugcgaugaaucaaaccagaggaguuugucaugcuccccacagagagcccaggacauuugcc

SEQ ID NO: 3021 - RNA, 63 nt, Homo sapiens
gcugcguagugaccacaagcuuaugugcagcacugcucagggaggcugucaggaauuccccuc

SEQ ID NO: 3022 - RNA, 63 nt, Homo sapiens
gcugcguuucuccuuucuguccgugggcagcccaguccccacagucacggccaagccacgcag

SEQ ID NO: 3023 - RNA, 63 nt, Homo sapiens
gcugcuggauguugacgaaggaagcggcggcgcagcucagggaucuccgagucaggacggucg

SEQ ID NO: 3024 - RNA, 63 nt, Homo sapiens
gcugcuuugccaaugaagaaugaaauaaauuuaucugaauguaucaauaacuuucccuugggu

SEQ ID NO: 3025 - RNA, 63 nt, Homo sapiens
gcuggaauuacaguugugagccaccacaccuggcuugaauguagauuuuaauaauugaauuua

SEQ ID NO: 3026 - RNA, 64 nt, Homo sapiens
gcuggccagggacagcaguuugcacagcagaggggaauguagcaacagcagggccuccuaggcc

SEQ ID NO: 3027 - RNA, 63 nt, Homo sapiens
gcugucccacuuauaacugugcucuacuuagcauucucagggaucauaccuuaauguuuucag

SEQ ID NO: 3028 - RNA, 63 nt, Homo sapiens
gcuguccccucuugccccaacccccagcacccgggcucagggaccacagcaaggcaccugcag

SEQ ID NO: 3029 - RNA, 63 nt, Homo sapiens
gcugugacggaggcuaguguggaagagguccuguccucagggaauuaacugucuuauugggag

SEQ ID NO: 3030 - RNA, 61 nt, Homo sapiens
gcuguggcggagcucccgcccccugcgcccuaauggugcuaacccccucucacuacccagc

SEQ ID NO: 3031 - RNA, 62 nt, Homo sapiens
gcugugggggggaagcgcgugugcaucgugucaacuacuguacauguuggucaugugaaagg

SEQ ID NO: 3032 - RNA, 63 nt, Homo sapiens
gcuguucccuaaucccacccccugcccugagacagugaauguaguccgugaagggagugccuc

SEQ ID NO: 3033 - RNA, 63 nt, Homo sapiens
gcuguugaaaagaaagaagaaggaggcggaaaucucucagggagaauuauuuccuuucuuuuc

SEQ ID NO: 3034 - RNA, 64 nt, Homo sapiens
gcuguuuuuauagcacauagaugucuguaaccaauaauguagcaguucugcacuuugacacaag

SEQ ID NO: 3035 - RNA, 62 nt, Homo sapiens
gcuuaaaguggcauuauugacugcugaugugaugcuacuguaaugcaauaaauuuuuaaauu

SEQ ID NO: 3036 - RNA, 63 nt, Homo sapiens
gcuuaaguccuaccucaucuuuauuuuuuuacagaugaauguacuuaucuuuucugcagggau

SEQ ID NO: 3037 - RNA, 63 nt, Homo sapiens
gcuuccugauugcgcagacugaaacuagcuaaaccugaauguaccuacuagggcaccauaaua

SEQ ID NO: 3038 - RNA, 63 nt, Homo sapiens
gcuucuaaccccaguagaguagaacuaaauugcacugaauguauaguuaacucugucuugaau

SEQ ID NO: 3039 - RNA, 62 nt, Homo sapiens
gcuugaggcucagaagagccucuguccagccccucaguauuaccaugucucccucucagggg

SEQ ID NO: 3040 - RNA, 64 nt, Homo sapiens
gcuuggcucucuacacauggcauuucaggguauaagauguagcauuucaauguguaagauauau

SEQ ID NO: 3041 - RNA, 61 nt, Homo sapiens
gcuuucucccugucuggauucaguggcucacguuggugcuacacagcuagaauagauauau

SEQ ID NO: 3042 - RNA, 63 nt, Homo sapiens
gcuuugggaagagcugcugagcucuuugccugccacucagggagugcaauuguucuuaaagag

SEQ ID NO: 3043 - RNA, 62 nt, Homo sapiens
gcuuuguuuugugguaguccuuuugggaagaauccaguauuauccacaauuauuggcaaagu

SEQ ID NO: 3044 - RNA, 62 nt, Homo sapiens
gcuuuuguacuuauauuuuucagaggaaaaaacacuacuguaaauugugaauagccaauaca

SEQ ID NO: 3045 - RNA, 61 nt, Homo sapiens
gcuuuuuuuuccguuuuuguucauuuuggaugcuggugcuaaaccuccaagugucaugauu

SEQ ID NO: 3046 - RNA, 63 nt, Homo sapiens
ggaaaaaaaaaucuuguggauugauugcuuugccauccccacagcagcuuuugcaaauugcuu

SEQ ID NO: 3047 - RNA, 63 nt, Homo sapiens
ggaaaacuuacuuuucauggagugccaccuaacagugaauguauuagaguauaaaauguuugc

SEQ ID NO: 3048 - RNA, 63 nt, Homo sapiens
ggaaaccagggucccgggcaggcccggcgcuuugcuccccacaccagcccccugcgcgugucc

SEQ ID NO: 3049 - RNA, 63 nt, Homo sapiens
ggaaacuguucccuggaaccacuccacucccugcauccccacacuucacagcaucuuccaucc

SEQ ID NO: 3050 - RNA, 62 nt, Homo sapiens
ggaaagaaauaccauauacauagauggaaaaacccaguauuauaaaaaccucaauucugaaa

SEQ ID NO: 3051 - RNA, 61 nt, Homo sapiens
ggaaagagaaugcuucccauagaaagcccgacauggugcuaguuuccucucuuggagagcc

SEQ ID NO: 3052 - RNA, 63 nt, Homo sapiens
ggaaaggaaugcugacuuucucuuucuuucucuuguccccacacccauucccaacccaauacu

SEQ ID NO: 3053 - RNA, 62 nt, Homo sapiens
ggaaaguuuuugugagcuguguaaucccucuggucaguauuaugaaaucauuugucaguggu

SEQ ID NO: 3054 - RNA, 63 nt, Homo sapiens
ggaaauuaacacuggaacugacccuuuucuggcagugaauguaagcucuagcucccccaucua

SEQ ID NO: 3055 - RNA, 62 nt, Homo sapiens
ggaacacuuuccucuucuaugaccccucucuccccaguauuaucuuacuugcaaaauggaga

SEQ ID NO: 3056 - RNA, 63 nt, Homo sapiens
ggaaccaucaucccgcuucucuccggccugagcaucucagggagaccaggggccgagccgcug

SEQ ID NO: 3057 - RNA, 62 nt, Homo sapiens
ggaacuaauuucuucuccuggaguugcauugauucaguauuacaaauauauagcacaucacc

SEQ ID NO: 3058 - RNA, 62 nt, Homo sapiens
ggaacuaugcaaaggaaauuuacgauauucaagaguaugauauuaucacugaaccgauuaau

SEQ ID NO: 3059 - RNA, 63 nt, Homo sapiens
ggaacugccacauacagggccaggccuacccuccuuccccacaagcccccuccaacccccacc

SEQ ID NO: 3060 - RNA, 62 nt, Homo sapiens
ggaacugcucaucuaagcaaaagauuugaguaugauaugauaaaggcuuucuacauucuaau

SEQ ID NO: 3061 - RNA, 63 nt, Homo sapiens
ggaagaaaccaagacagagagcuuaacucacuucucucagggaaaauuaggaguugagcacag

SEQ ID NO: 3062 - RNA, 63 nt, Homo sapiens
ggaagccauuugcagugcugguguguccugcucccuccccacauuccccaugcucaaggccca

SEQ ID NO: 3063 - RNA, 63 nt, Homo sapiens
ggaaggacaggcuuuccccuguauaucauaggaaacucagggacauuucaaguugcugagagu

SEQ ID NO: 3064 - RNA, 50 nt, Homo sapiens
ggaagguaauuucaccugaggucucagggaaccacgaagggauauggcaa

SEQ ID NO: 3065 - RNA, 63 nt, Homo sapiens
ggaaguagggauauuuuuauaaaacaauuguguccuccccacauuuugcuauguuaauauuug

SEQ ID NO: 3066 - RNA, 64 nt, Homo sapiens
ggaauaagcaaaauucauaccugacuaguguucagaauguagcauucugugcgaaaaaguauug

SEQ ID NO: 3067 - RNA, 62 nt, Homo sapiens
ggaauaguuuaacagucaggaaggcuaaacuggucaguauuaauguguagcccuaccaaaaa

SEQ ID NO: 3068 - RNA, 62 nt, Homo sapiens
ggaaugcagauucauacccagccagccuuugccucuacuguaucgcuuugggacuuuaaaga

SEQ ID NO: 3069 - RNA, 64 nt, Homo sapiens
ggaauuacauuuuccaacagaccaaaaaauguuuucauguagcagcaaugcagauuuggugaau

SEQ ID NO: 3070 - RNA, 61 nt, Homo sapiens
ggacaaaagucaggaugaaaaguaaucuaucgcuggugcuacuuuaauaccuuccugacug

SEQ ID NO: 3071 - RNA, 61 nt, Homo sapiens
ggacaccgaggggacugccccccacccccaccauggugcuauucuggggcuggggcagucu

SEQ ID NO: 3072 - RNA, 64 nt, Homo sapiens
ggacacucagagugggagcacaucccagcagugcccauguagcaggagcacaguggauggccuu

SEQ ID NO: 3073 - RNA, 63 nt, Homo sapiens
ggacagcucccaguauacuguggacugugauaaacugaauguauguuuuuuaaugguuuauug

SEQ ID NO: 3074 - RNA, 63 nt, Homo sapiens
ggacauauaacuacuuaucucuaguggugggauucugaauguauaauacauauguuguacuuu

SEQ ID NO: 3075 - RNA, 63 nt, Homo sapiens
ggacauuugacuuuuauuuuuguauuuaauugacaugaauguaaaggggacagcucaggguug

SEQ ID NO: 3076 - RNA, 61 nt, Homo sapiens
ggaccaccguuucuccugaggcccuggggucaccucagggacagcguccaggcuucagcca

SEQ ID NO: 3077 - RNA, 61 nt, Homo sapiens
ggaccucugaaacccuggaccaguggucucacauggugcuacgccugcauguaaacacgcc

SEQ ID NO: 3078 - RNA, 62 nt, Homo sapiens
ggacuaggcugaagaugugucuucuccccgccaccuacuguaugacaccacauucuuccuaa

SEQ ID NO: 3079 - RNA, 61 nt, Homo sapiens
ggacuugguuugagggagggggaaucacagauuuggugcuaaguuaauuagaaacuggcag

SEQ ID NO: 3080 - RNA, 61 nt, Homo sapiens
ggagaaaauaauuuuuauggguuuuuuugguuauggugcuauuccuaagguuaacuuugaa

SEQ ID NO: 3081 - RNA, 64 nt, Homo sapiens
ggagaagcauuguggggcaauuguuccuccuugacaauguagcaauaaauagaugcugccaagg

SEQ ID NO: 3082 - RNA, 54 nt, Homo sapiens
ggagacagaaacggagugacccgccgugaauguagacgcccuaggaggagaacu

SEQ ID NO: 3083 - RNA, 63 nt, Homo sapiens
ggagaggagggcagggcgugcagggccuugugggccucagggaggacuugggcaccuacgccg

SEQ ID NO: 3084 - RNA, 51 nt, Homo sapiens
ggagcacaccguuuccugauuugcucagggacucaucuuucccuccuuggu

SEQ ID NO: 3085 - RNA, 63 nt, Homo sapiens
ggagcauuuacagaugaauccccacacuuagccauugaauguaaaggggaaaaauaaggugag

SEQ ID NO: 3086 - RNA, 63 nt, Homo sapiens
ggagccagcacguugaccucccucucagcucccugcucagggacgguggacagguugccuacu

SEQ ID NO: 3087 - RNA, 57 nt, Homo sapiens
ggagcgaaagugccccugauuggcacuccuccccacacaccugcucccaagcucaga

SEQ ID NO: 3088 - RNA, 63 nt, Homo sapiens
ggagcugacaacccuugguggagggagggugcccuugaauguauuaaaacuaucacccaaaga

SEQ ID NO: 3089 - RNA, 63 nt, Homo sapiens
ggagcugcagagccuggcaggguuugcuggacaugcucagggacgggccauggugcuggcucu

SEQ ID NO: 3090 - RNA, 61 nt, Homo sapiens
ggaggagcacauuuuucuugacccucaccuaccuggugcuaguuggucaacccugccugca

SEQ ID NO: 3091 - RNA, 63 nt, Homo sapiens
ggaggccaaacccaagaaggucuggcaaagucaggcucagggagacucugcccugcugcagac

SEQ ID NO: 3092 - RNA, 63 nt, Homo sapiens
ggaggccggcuacugagggcucccagcacgcucucuccccacaucgucugcccaucuggguuu

SEQ ID NO: 3093 - RNA, 63 nt, Homo sapiens
ggaggccucugcaagauucugugggcagcuggcucugaauguagccagcccacauccauucca

SEQ ID NO: 3094 - RNA, 63 nt, Homo sapiens
ggaggcugucccaucucccaguccccaucucuuuuuccccacacugucccuggccaagcccug

SEQ ID NO: 3095 - RNA, 62 nt, Homo sapiens
ggaggcuuuggguggcucacuacugaacacauguguaugauacuaaagacgguauuaaaaug

SEQ ID NO: 3096 - RNA, 61 nt, Homo sapiens
ggagggaacagaaguuaggaggcaacuuugggauggugcuagagcauggaaagcacagaga

SEQ ID NO: 3097 - RNA, 61 nt, Homo sapiens
ggagggaacauccugcugcaugaccuaucaguauggugcuaaugugucuguggacccucgc

SEQ ID NO: 3098 - RNA, 63 nt, Homo sapiens
ggagggaggcaggcuggggagaagagaacauuagacucagggaauauuuaauucugguuuuag

SEQ ID NO: 3099 - RNA, 61 nt, Homo sapiens
ggagggcccuucagagcagaguccacaggcggguggugcuacauacacaagcuuaguguac

SEQ ID NO: 3100 - RNA, 63 nt, Homo sapiens
ggagggccgggcugugcugagcucuggggggccgguccccacagcucccccgacagggccccc

SEQ ID NO: 3101 - RNA, 56 nt, Homo sapiens
ggaggugaugcugaagugaggcagccccuccccacaccaguugaacugcaggaaga

SEQ ID NO: 3102 - RNA, 63 nt, Homo sapiens
ggaggugggggaacuggacuccggcauaagccacuuccccacaaacccccaccagcaaggggc

SEQ ID NO: 3103 - RNA, 64 nt, Homo sapiens
ggaguuauguuuuuaaauuuggaaauaugacauuuuauguagcacuuuauaaaaagugaaagcg

SEQ ID NO: 3104 - RNA, 61 nt, Homo sapiens
ggauaaaacacgucauguggauucauuuugaauuggugcuauugguauuuccucuguuauu

SEQ ID NO: 3105 - RNA, 62 nt, Homo sapiens
ggauaaauuaacuuuuacagaaaucuuguuuacuguaugauauucuaaaacacugucaaaua

SEQ ID NO: 3106 - RNA, 63 nt, Homo sapiens
ggauaucuuuguccauauacccagguguccugauuugaauguacuauuugauccucauugugu

SEQ ID NO: 3107 - RNA, 63 nt, Homo sapiens
ggaugaguggcuuccauggagagauuuccugauuucucagggaggaaaaaagugaugacauuu

SEQ ID NO: 3108 - RNA, 63 nt, Homo sapiens
ggaugccuugccuggauccccagccauggauccagcucagggaaccuccaugugaacagagcu

SEQ ID NO: 3109 - RNA, 63 nt, Homo sapiens
ggaugcucgcaggguggcaguggcccagccccagccucagggacggggagggagagcccccuc

SEQ ID NO: 3110 - RNA, 62 nt, Homo sapiens
ggauguuggaacauacccaauugauaaaagaggacuacuguaaguucucuguucuuuguuuc

SEQ ID NO: 3111 - RNA, 63 nt, Homo sapiens
ggauuauuuauaugaaguccauaauguucgaguaccucagggacauuuaagaguuggaggugc

SEQ ID NO: 3112 - RNA, 63 nt, Homo sapiens
ggauucccacauuugucuucuuucugucuuuaagacucagggaggcuaaaucaguguuugauu

SEQ ID NO: 3113 - RNA, 63 nt, Homo sapiens
ggauuccuggccagcuccugccaccuccagcagaccucagggaggguugaguuucucuaagga

SEQ ID NO: 3114 - RNA, 63 nt, Homo sapiens
ggauuggaacuaucauggucacugcuccucuccccuccccacaaaaggaaaaaaaagcuggau

SEQ ID NO: 3115 - RNA, 63 nt, Homo sapiens
ggauuugggcugccccaggcccacccagggggcucugaauguauuuuguaccguguuucuuuc

SEQ ID NO: 3116 - RNA, 63 nt, Homo sapiens
ggcaagcaaaagcccauguccaggagcccuggguguccccacaggcucgccucugagagccuc

SEQ ID NO: 3117 - RNA, 63 nt, Homo sapiens
ggcaauccugggaaggucuggagguuccuguggaccucagggaagccaggggcagcugucagg

SEQ ID NO: 3118 - RNA, 61 nt, Homo sapiens
ggcacagggccacuguccuccaggcaggcuuuuuggugcuaggcccugggacuggaagucg

SEQ ID NO: 3119 - RNA, 61 nt, Homo sapiens
ggcacauuuguggguuccccaucagccaggccuuggugcuaaccuggcugaauuucacaca

SEQ ID NO: 3120 - RNA, 63 nt, Homo sapiens
ggcacugagccugguacccuguggcauggagaagccucagggaaaggccugcccccccagcac

SEQ ID NO: 3121 - RNA, 63 nt, Homo sapiens
ggcacuggguagagcaccugguccacguggauugucucagggaagccuugaaaaccacggagg

SEQ ID NO: 3122 - RNA, 63 nt, Homo sapiens
ggcagaauuucugaccccuuuggcucagcugcccuuccccacaaauaaaaaccaacaaagagg

SEQ ID NO: 3123 - RNA, 63 nt, Homo sapiens
ggcagccagcugcaugugaccauucuguugccagcuccccacacaucccuccugucacccagg

SEQ ID NO: 3124 - RNA, 61 nt, Homo sapiens
ggcagccccagcccagcccgccgggagcaaggauggugcuaggucauucauggcuggccuc

SEQ ID NO: 3125 - RNA, 63 nt, Homo sapiens
ggcagccucuagagccuucuugcuuucauuuuccuugaauguacauaggaacaagggggaaag

SEQ ID NO: 3126 - RNA, 62 nt, Homo sapiens
ggcagcguagaagugguauauccaaguauaucagcuacuguaguugucacagucuugugaac

SEQ ID NO: 3127 - RNA, 63 nt, Homo sapiens
ggcaggugggggcuugguugcugacccggcccaaguccccacagagcaccuucuguagcucca

SEQ ID NO: 3128 - RNA, 63 nt, Homo sapiens
ggcaucucaggaacagugagggcaacaagcugucccucagggacccucaccugcccucccaug

SEQ ID NO: 3129 - RNA, 62 nt, Homo sapiens
ggcauggugcccucagccuuugcauauacucucucaguauuaacucccaguaaauaauaacc

SEQ ID NO: 3130 - RNA, 61 nt, Homo sapiens
ggcauuggugucuggagaccuggauuugagucuuggugcuaucaaucaccgucuguguuug

SEQ ID NO: 3131 - RNA, 62 nt, Homo sapiens
ggcauuugcugcuaaaggauacccagaacccucacuacuguaacauacaacgguucagcugu

SEQ ID NO: 3132 - RNA, 63 nt, Homo sapiens
ggccaaaaccugguauggucauugggaaaugagugcucagggagauggagcuuaggggaggug

SEQ ID NO: 3133 - RNA, 62 nt, Homo sapiens
ggccaaacucuucugucacuaucaguguccaucucuacuguacucccucagcaucagagcau

SEQ ID NO: 3134 - RNA, 62 nt, Homo sapiens
ggccaagccauuacgggagcacagcaugugcugacuacuguacuuccagaccccugcccucu

SEQ ID NO: 3135 - RNA, 63 nt, Homo sapiens
ggccaccccugccucugggccagggaaaccagcuacucagggacuucucuugccuggagggug

SEQ ID NO: 3136 - RNA, 63 nt, Homo sapiens
ggccacucuccccaccacgucugugcccugcacuguccccacagccuuccacacccugugcau

SEQ ID NO: 3137 - RNA, 63 nt, Homo sapiens
ggccagcuuuuccucaccaggagcccggcuuccacuccccacauaggaauaguccauccccag

SEQ ID NO: 3138 - RNA, 63 nt, Homo sapiens
ggcccaucugucagcagcgucuucuagguccccagcucagggagccauccccagcuccaguuu

SEQ ID NO: 3139 - RNA, 63 nt, Homo sapiens
ggcccccacacccaggucagacaucacgugcacccugaauguaggcaagggccuggcccugca

SEQ ID NO: 3140 - RNA, 63 nt, Homo sapiens
ggccccccugggggggcugccuuccccucagccucuccccacaccacccacccagcugcuguc

SEQ ID NO: 3141 - RNA, 62 nt, Homo sapiens
ggcccccgagccccgauagggugcugccuggcccuccccacaaugccagaccgcagagaggc

SEQ ID NO: 3142 - RNA, 63 nt, Homo sapiens
ggcccguggagacugagaucacugacucugacucauccccacagcuggcucugacaagauggu

SEQ ID NO: 3143 - RNA, 61 nt, Homo sapiens
ggcccucucaggccaaacaucuuuccucuucuguggugcuaaaauucuguaugaccagaca

SEQ ID NO: 3144 - RNA, 63 nt, Homo sapiens
ggcccugggccugcuccuugccaccaaccgaaccgugaauguagggcccccagccucaccucu

SEQ ID NO: 3145 - RNA, 61 nt, Homo sapiens
ggccgucuuggugucucguggcacgcgucacaguggugcuagucuguuuuuaacaaaagag

SEQ ID NO: 3146 - RNA, 62 nt, Homo sapiens
ggccucaaggcccuggcacacagaagaugcguaucaguauuaucaaccaauaguugaugaau

SEQ ID NO: 3147 - RNA, 63 nt, Homo sapiens
ggccucagggagcugcugaggggugcugagccuggcucagggagcugggaccccuccccucca

SEQ ID NO: 3148 - RNA, 63 nt, Homo sapiens
ggccugcccucagccccacuccuguucugcaacuguccccacaggaaggggcucuguucccug

SEQ ID NO: 3149 - RNA, 63 nt, Homo sapiens
ggccuggggggccugggcuuaucugggccuucucacucagggacucucuugacgcugacuugc

SEQ ID NO: 3150 - RNA, 62 nt, Homo sapiens
ggcgaaucuuaaaacaggcaugugccaccaauaucuacuguacauucuacaagcauugcuuu

SEQ ID NO: 3151 - RNA, 63 nt, Homo sapiens
ggcgagggcagaccccaggggaaagcaaagggcgucucagggaacccccacauucucucacug

SEQ ID NO: 3152 - RNA, 63 nt, Homo sapiens
ggcgcgggggggaggcuggggucccgccgccgugaugaauguacugacgagccgaggcagcag

SEQ ID NO: 3153 - RNA, 62 nt, Homo sapiens
ggcgcuagaugcaaggugcuagaccaaugggcugcaguauuauagcccccaggccuggcagg

SEQ ID NO: 3154 - RNA, 61 nt, Homo sapiens
ggcggaagagucagaggacccugugcuugcugguggugcuaacacaauuucugguguucaa

SEQ ID NO: 3155 - RNA, 63 nt, Homo sapiens
ggcggcaaggggggaaugggaguugucuccccuucuccccacaccugaucugcucucggcugg

SEQ ID NO: 3156 - RNA, 63 nt, Homo sapiens
ggcuagaugagcccagauuucuucccccuccaucucucagggagacaaagaaccuccuuccug

SEQ ID NO: 3157 - RNA, 63 nt, Homo sapiens
ggcuauuucaaaggaaccagccaacguaugagaaaugaauguaacacuguggacauugacuuc

SEQ ID NO: 3158 - RNA, 63 nt, Homo sapiens
ggcuauuuuaaaugucaaggucagcaguguuacuuugaauguaaacugguauaauagguaguu

SEQ ID NO: 3159 - RNA, 63 nt, Homo sapiens
ggcuccagggcuggcucugguguuuacaagcuggacucagggauccuccuggccgccccgcag

SEQ ID NO: 3160 - RNA, 63 nt, Homo sapiens
ggcucccgugcacuagcuuguuacagcugccucuguccccacaugugggggcaccuucuccag

SEQ ID NO: 3161 - RNA, 63 nt, Homo sapiens
ggcucuaugaauguacauggaaugaccaggcucuaugaauguacauggaaaaccccuaaaaau

SEQ ID NO: 3162 - RNA, 62 nt, Homo sapiens
ggcugaaaacccaugcugcuguuauacacaauggcaguauuaacaagcauuuuaaaccuuug

SEQ ID NO: 3163 - RNA, 62 nt, Homo sapiens
ggcugacaaccucguaagcccuugcuuagaaauacaguauuagucuaauugaguaauuagug

SEQ ID NO: 3164 - RNA, 62 nt, Homo sapiens
ggcugagagaguuaagugaaugucuaaggucacacaguauuaagugacagugcuagaaauca

SEQ ID NO: 3165 - RNA, 63 nt, Homo sapiens
ggcugagauuuuucuaaauugaaaacacgccccccuccccacaccuccaggaacuccacuccc

SEQ ID NO: 3166 - RNA, 62 nt, Homo sapiens
ggcugcaucuguuucgugcugguccuguugacuuguaugauauccacaaauaaauauuuuca

SEQ ID NO: 3167 - RNA, 62 nt, Homo sapiens
ggcugccagcugagccaccugucuuccacuguaucuacuguacgaacuucuccagcucugcu

SEQ ID NO: 3168 - RNA, 62 nt, Homo sapiens
ggcugcggagacucaccuucccgagcuaacuuaacuacuguacauaauaauauguauuaaac

SEQ ID NO: 3169 - RNA, 62 nt, Homo sapiens
ggcuggacaugguggcgcaugucuguaaucccagcuacuguaaucucagcuacuugggaggc

SEQ ID NO: 3170 - RNA, 63 nt, Homo sapiens
ggcugugcaccuauucuguaguugcagcugaugccugaauguauccuagcugacaaauuauug

SEQ ID NO: 3171 - RNA, 62 nt, Homo sapiens
ggcuucguguuagauaauuuugcuaaacaguaggcuacuguaaguguucugagcauauuuaa

SEQ ID NO: 3172 - RNA, 61 nt, Homo sapiens
ggcuucuuguccuucucuuugacuucuguggcauggugcuagugcauguacccugugguau

SEQ ID NO: 3173 - RNA, 63 nt, Homo sapiens
gggaaaggaguuugaaugugucuauuuuuuucuagugaauguauuuuaaccacaguguccuaa

SEQ ID NO: 3174 - RNA, 62 nt, Homo sapiens
gggaaccuuaaugaccaacagauccuagaagacaguaugauauuuucucuggccaguugcau

SEQ ID NO: 3175 - RNA, 61 nt, Homo sapiens
gggaagcuagauggacuaggagagacuugauuuuggugcuaaaguuccccaguucauaugu

SEQ ID NO: 3176 - RNA, 51 nt, Homo sapiens
gggaauucgccugaccuaaccugcucagggaucuuucuucccagcccugga

SEQ ID NO: 3177 - RNA, 63 nt, Homo sapiens
gggacagagggugucaaacauucgugagcuggggacucagggaccggugcugcaggagugucc

SEQ ID NO: 3178 - RNA, 62 nt, Homo sapiens
gggaccauuguuuauaaauuuauugcuaaucuuacaguauuaggauucauuauaaaaaccaa

SEQ ID NO: 3179 - RNA, 63 nt, Homo sapiens
gggaccugugcuggccugugcucaacacgggccccuccccacagaaagcugcuccuggaugcc

SEQ ID NO: 3180 - RNA, 64 nt, Homo sapiens
gggaccuuguucucugauaaagggcuuaaucuuuccauguagcaaagcaacuuucccucccucc

SEQ ID NO: 3181 - RNA, 61 nt, Homo sapiens
gggacugcugugcagacccaagcaaucccaaccuggugcuaggucauuucacuuuucugaa

SEQ ID NO: 3182 - RNA, 63 nt, Homo sapiens
gggagaaaaacauuuuagauauguauuacuauacaugaauguauuauacacacacacuuuaga

SEQ ID NO: 3183 - RNA, 63 nt, Homo sapiens
gggagagagccgcgggguccugcccgugguuacuaugaauguauugcuguuggaggacaucuc

SEQ ID NO: 3184 - RNA, 63 nt, Homo sapiens
gggagccgugacacgcagcauuuuccugccguucucucagggacucucagggcagcuccugcc

SEQ ID NO: 3185 - RNA, 63 nt, Homo sapiens
gggagcgugcaccaggugaggugagcgugugugcucucagggaagggcccaggaucccaugcc

SEQ ID NO: 3186 - RNA, 64 nt, Homo sapiens
gggagcuggggccugccacugaguaacagcucacacauguagcacacuuaugcgucaggcacca

SEQ ID NO: 3187 - RNA, 62 nt, Homo sapiens
gggauaacauaccugauggagaaauguuuuguguguaugauauaugggaaagucuuuaguua

SEQ ID NO: 3188 - RNA, 62 nt, Homo sapiens
gggcaccuccuugaagaagcugauagcuuuuacacaguauuagauugaaauaauggacagaa

SEQ ID NO: 3189 - RNA, 62 nt, Homo sapiens
gggcacuaaacaaaacaaccaauaaagucaccagcaguauuacuaucacaccaacagccaca

SEQ ID NO: 3190 - RNA, 63 nt, Homo sapiens
gggcagacgacaaccugggcgccucgcccagcuccuccccacagccauuggcauccacuguca

SEQ ID NO: 3191 - RNA, 63 nt, Homo sapiens
gggcagcuuuauuccuguugggccucaguuucucuuccccacacaguuuaucuuccgucacau

SEQ ID NO: 3192 - RNA, 63 nt, Homo sapiens
gggccacuauagcagccaccagaagccgcgaggcccucagggaagcccaaggccugcagaagc

SEQ ID NO: 3193 - RNA, 63 nt, Homo sapiens
gggcccccuccccaccaaaggguucaccucacacuugaauguacaacccaccccacugucggg

SEQ ID NO: 3194 - RNA, 61 nt, Homo sapiens
gggcccucagguguguguacuuuggacaauaaauggugcuaugacugccuuccgccauccc

SEQ ID NO: 3195 - RNA, 62 nt, Homo sapiens
gggccggggagucccugucucucacagcaucuagcaguauuauuaaauggauucauuuuaaa

SEQ ID NO: 3196 - RNA, 63 nt, Homo sapiens
gggccuccguccccagguccccaguggggcagcccuccccacagacgagccccccacauggug

SEQ ID NO: 3197 - RNA, 63 nt, Homo sapiens
gggcuauagcucaggaccugggaccuccccugaggcucagggaaaggccagugugaaccgagg

SEQ ID NO: 3198 - RNA, 63 nt, Homo sapiens
gggcugcacgggaugcgugggaggcagaaaccuaucucagggagggaaggggauggaggccag

SEQ ID NO: 3199 - RNA, 63 nt, Homo sapiens
gggcuucacucuucccacucacggaagggagguagcucagggaccuccacugugggacccuug

SEQ ID NO: 3200 - RNA, 63 nt, Homo sapiens
gggcuucagugucgauugagauugcuuuuguucaucucagggauuucaauagucaagaaugaa

SEQ ID NO: 3201 - RNA, 63 nt, Homo sapiens
gggcuuugaagcagccuuuggugggcaaacggcaucucagggaacccuggccugucuccucca

SEQ ID NO: 3202 - RNA, 64 nt, Homo sapiens
gggcuuuuccuuuugcauaaaggcuaguaacuguauauguagcauggauuuaauuagucaugau

SEQ ID NO: 3203 - RNA, 64 nt, Homo sapiens
ggggaaauugcagauuuugacaagcuuaauguguauauguagcaaaaugguuuuuaaguacuug

SEQ ID NO: 3204 - RNA, 63 nt, Homo sapiens
ggggaagggauuguuguguagucaagucaccaugcugaauguacacugauuccuuuaugauga

SEQ ID NO: 3205 - RNA, 62 nt, Homo sapiens
ggggauuuuauucaucccgucugagcucuucauacaguauuaccauuagguuuuaagaacaa

SEQ ID NO: 3206 - RNA, 63 nt, Homo sapiens
ggggcagggcagugcccuggggguaagcuagguggcucagggaguggcagaagggccauuuuu

SEQ ID NO: 3207 - RNA, 63 nt, Homo sapiens
ggggccuccuugccuggcuucuuccuccagcuauccucagggaagcuggagauucaagucaug

SEQ ID NO: 3208 - RNA, 63 nt, Homo sapiens
ggggcuggugauucccaccuucacccugucauggucucagggaacagccugcuucccaccagc

SEQ ID NO: 3209 - RNA, 63 nt, Homo sapiens
ggggcuguugccccucccuccaucuccccacacccaccccaccccacagcagggcuccuggcc

SEQ ID NO: 3210 - RNA, 62 nt, Homo sapiens
gggggauagugagaaccuaagccccaucguagcacaguauuacaugugguugggaaaaauaa

SEQ ID NO: 3211 - RNA, 62 nt, Homo sapiens
gggggugggccguggagucggaguggacaccgcucaguauuacuuucugccgcugucaaggc

SEQ ID NO: 3212 - RNA, 63 nt, Homo sapiens
gggguacucagcuccaucuccaaagauaaaccuacuccccacaagaacuggccuuuaaugugg

SEQ ID NO: 3213 - RNA, 62 nt, Homo sapiens
ggggucguauucuaagugcuaaagaaggcugcuucuacuguauagaacccagggcucugaaa

SEQ ID NO: 3214 - RNA, 61 nt, Homo sapiens
ggggucucagcagaaccccacugucccuccccuuggugcuagaggcuugugugcacgugag

SEQ ID NO: 3215 - RNA, 64 nt, Homo sapiens
ggguaaacucaaagcuuccuaugagaagcuucugagauguagcaggucacagaaguguucaccu

SEQ ID NO: 3216 - RNA, 64 nt, Homo sapiens
ggguaugaauucccugacacacauucaugucaacauauguagcaaauuuugugaaaacauaaca

SEQ ID NO: 3217 - RNA, 64 nt, Homo sapiens
ggguccucugggcaguagaggcaaagcucaccucccauguagcacaugaaaugcuugugaguug

SEQ ID NO: 3218 - RNA, 63 nt, Homo sapiens
gggucgucuuagcagagccaccgccaagguuugcacucagggaggggcugauggagggcuggg

SEQ ID NO: 3219 - RNA, 63 nt, Homo sapiens
gggucuccucuccucugagcagccacauagaacauuccccacauauccaaagcugcccagggg

SEQ ID NO: 3220 - RNA, 62 nt, Homo sapiens
gggucucuacaagugacagauguguuguuuucaacaguauuauuagguuaugaauaaagccu

SEQ ID NO: 3221 - RNA, 61 nt, Homo sapiens
gggucuugcucuguuacccaggcuggagugcaguggugcuaucuaggcuuacugcaaccuc

SEQ ID NO: 3222 - RNA, 64 nt, Homo sapiens
ugccuuuuguguaccaggaacucuuaaacacugaagauguagcaauaaaccaaaugugcuaaaa

SEQ ID NO: 3223 - RNA, 57 nt, Homo sapiens
ugcgaaaucauacagcugaggaaacccuaugaauguaaggaauguggaaaagccuuc

SEQ ID NO: 3224 - RNA, 63 nt, Homo sapiens
ugcguccccaccgugaccugccuggccuccccugucucagggagcaggucacaggucaccaug

SEQ ID NO: 3225 - RNA, 61 nt, Homo sapiens
ugcguggggagagggugaagaagggcuuuugccuggugcuagacugccuggguucaaaucc

SEQ ID NO: 3226 - RNA, 63 nt, Homo sapiens
ugcguggggagguggggucucauucccccaacuuccucagggaggaccccugcccuccgcugc

SEQ ID NO: 3227 - RNA, 64 nt, Homo sapiens
ugcuaauaccaacuauuucaauaaguguuguaccauauguagcauuaaauauaaaauacauaaa

SEQ ID NO: 3228 - RNA, 63 nt, Homo sapiens
ugcuacagccuccaguauguucgcauuaucucaaacucagggaccccacaggacaggagacac

SEQ ID NO: 3229 - RNA, 63 nt, Homo sapiens
ugcuaccagcugugugugucaaucacuccauuuugcucagggaaggcagacuucugugcuuuc

SEQ ID NO: 3230 - RNA, 62 nt, Homo sapiens
ugcuacccucccaauucccccauuauggaguaaccaguauuauucagugagcuaugggguag

SEQ ID NO: 3231 - RNA, 62 nt, Homo sapiens
ugcuagaaaucuugugccccauaugugcuucuuucaguauuauccuagauccucaggaguag

SEQ ID NO: 3232 - RNA, 62 nt, Homo sapiens
ugcuaguuguuaucaauuaaugacaauuacaaaccuacuguaucucuaauacagugugacug

SEQ ID NO: 3233 - RNA, 63 nt, Homo sapiens
ugcucccaucccccaagucugacgcagccaccacucucagggauccugccccaaaugcggucg

SEQ ID NO: 3234 - RNA, 63 nt, Homo sapiens
ugcuccucuccagaguuuccggucaccuccguguucucagggagugcguggucuuggaugcca

SEQ ID NO: 3235 - RNA, 63 nt, Homo sapiens
ugcuccucuccagaguuuccucucaccuccguguucucagggagugcguggucuuggaugcca

SEQ ID NO: 3236 - RNA, 63 nt, Homo sapiens
ugcuccuggacagggacccugguaagagcucucuccucagggaggaaguagggguggggcuuu

SEQ ID NO: 3237 - RNA, 62 nt, Homo sapiens
ugcucuuuuugggaugccugaugucucaucacggcaguauuaucucucugggaccucugaca

SEQ ID NO: 3238 - RNA, 61 nt, Homo sapiens
ugcugcuaauguaacuugggcuacaacucuucauggugcuacaaacuucucugucucauuc

SEQ ID NO: 3239 - RNA, 62 nt, Homo sapiens
ugcugcuuaaaaggagacuuaguaaaguucucuuguaugauaauuugguauuuacucaaauc

SEQ ID NO: 3240 - RNA, 62 nt, Homo sapiens
ugcuguacuuguagcuucucucuguuccucuguacaguauuaauagacaauaaacugccuuu

SEQ ID NO: 3241 - RNA, 61 nt, Homo sapiens
ugcuguccauccuuuuucagggcguggacucccuggugcuagaaagcgugauguucgccau

SEQ ID NO: 3242 - RNA, 62 nt, Homo sapiens
ugcugugacacccugaaaaagcugaccacaaaugcaguauuaucuugacauaccucuguccc

SEQ ID NO: 3243 - RNA, 62 nt, Homo sapiens
ugcuguguugaaggcugugguuaauaaaacacaaguaugauaaacaggaccuagcguuuagc

SEQ ID NO: 3244 - RNA, 63 nt, Homo sapiens
ugcuuauauugacaacaaaucaucucgcuaaagagugaauguaggccaggcgcgguggcucau

SEQ ID NO: 3245 - RNA, 64 nt, Homo sapiens
ugcuuccauugagccacgucgguggugucauccuacauguagcauaauagagucucucagccuu

SEQ ID NO: 3246 - RNA, 61 nt, Homo sapiens
uggaaaagacacagaagccaaccugagaaccccuggugcuauuuuaaaggagacauauugc

SEQ ID NO: 3247 - RNA, 62 nt, Homo sapiens
uggaaacucagcacauuugaacuuggguuugauucaguauuaacagaucuugacuacacuaa

SEQ ID NO: 3248 - RNA, 62 nt, Homo sapiens
uggaaagcagagguugcagugagcugagaucacacuacuguacuacuguacuccagccuggg

SEQ ID NO: 3249 - RNA, 62 nt, Homo sapiens
uggaacaacaauaaaaacauuuuuuuaaacuugucuacuguaagauacugccaucauaaagc

SEQ ID NO: 3250 - RNA, 62 nt, Homo sapiens
uggaacauaagcaguguuaccccuggcugggagucaguauuauacaacaaauggugagcugg

SEQ ID NO: 3251 - RNA, 62 nt, Homo sapiens
uggaagagacgaaagaaaggaaaauaaacucuuuguaugauauuuauuaggaggaaagagga

SEQ ID NO: 3252 - RNA, 62 nt, Homo sapiens
uggacaaguuggcaggguauuuuaaaagcuauaacuacuguaguuuuccaguuuucauugcu

SEQ ID NO: 3253 - RNA, 63 nt, Homo sapiens
uggacauggcccggccccacugcugagugcccguguccccacagccccaugugccccaccccg

SEQ ID NO: 3254 - RNA, 64 nt, Homo sapiens
uggagaaucugaagaaugaaagacauugagaaaacuauguagcaagauccacuucugugauuaa

SEQ ID NO: 3255 - RNA, 63 nt, Homo sapiens
uggagauggaugaugguuaugggugcucaacagugugaauguacuuaaugccacagaacugca

SEQ ID NO: 3256 - RNA, 63 nt, Homo sapiens
uggagccuuuugaggggggccuucccucagcuguuuccccacacuggggggcugggcccugcc

SEQ ID NO: 3257 - RNA, 62 nt, Homo sapiens
uggaggaagauuccugcagccacuaaugcauuguguaugauaacaaaaacucugguaugaca

SEQ ID NO: 3258 - RNA, 63 nt, Homo sapiens
uggaggaggaaagggagccugcucucccuccccacaccccacccaaagcauacaccgcugagc

SEQ ID NO: 3259 - RNA, 63 nt, Homo sapiens
uggagucuucuuucaaaccaguggggguuggacaaugaauguaguuaacugguuccugcucac

SEQ ID NO: 3260 - RNA, 63 nt, Homo sapiens
uggagugucagcggaggccccaggcagcccaagagcucagggagccagggaccccaaggggag

SEQ ID NO: 3261 - RNA, 64 nt, Homo sapiens
uggauccacaggggcuaucgaggagacccagugagaauguagcauuuuguucauccccagggua

SEQ ID NO: 3262 - RNA, 62 nt, Homo sapiens
uggauuaauguggguuuuucuguucauuuuauugcaguauuaaaugcuuaagcuuauuagga

SEQ ID NO: 3263 - RNA, 62 nt, Homo sapiens
uggauugcaccucuguaaacuauuccuaaaauguguaugauauauuugaaaaggcuuccauu

SEQ ID NO: 3264 - RNA, 63 nt, Homo sapiens
uggauugcaguccccagucaccucuucugccagccuccccacauauggcacaacugucuaaug

SEQ ID NO: 3265 - RNA, 63 nt, Homo sapiens
uggcaaauaagaauguuugagcacacugcccacaaugaauguaacuauuuucuaaacacuuua

SEQ ID NO: 3266 - RNA, 63 nt, Homo sapiens
uggcaccacgacugagggcucccggcucggcuucuuccccacagcaggcugcucagagggggu

SEQ ID NO: 3267 - RNA, 63 nt, Homo sapiens
uggcagcauaauuuugugguuaagagaaugaauucugaauguacacuuucugucucaaacccu

SEQ ID NO: 3268 - RNA, 63 nt, Homo sapiens
uggcagcgaggcccucugcaagaagcucaaggaagcucagggaaaauggacguauucagagag

SEQ ID NO: 3269 - RNA, 63 nt, Homo sapiens
uggcaguuuuaaccaccaacguagaagcuuuuuuuuccccacaagaccauuguacugcaauac

SEQ ID NO: 3270 - RNA, 62 nt, Homo sapiens
uggcauaggacuggcauuauauagcagaaaucaacuacuguacaauuucuugggguuaacca

SEQ ID NO: 3271 - RNA, 64 nt, Homo sapiens
uggccaucuaccccugcuagaagguuacaguguauuauguagcaugcaauguguuauguagugc

SEQ ID NO: 3272 - RNA, 63 nt, Homo sapiens
uggcccccgaagaauggaacccacacccauagcucuccccacagcugauacggcauccugcga

SEQ ID NO: 3273 - RNA, 63 nt, Homo sapiens
uggccucugacucccgucucugugcuugcccccaucucagggaccaugaugucucagucacuc

SEQ ID NO: 3274 - RNA, 63 nt, Homo sapiens
uggccugacugugcugggggcuggguuaacguuuucucagggaaccacaaugcacgaaagagg

SEQ ID NO: 3275 - RNA, 61 nt, Homo sapiens
uggccuuuguccccuggagcccgaucagccaguuggugcuacugcuguggccagcuggggg

SEQ ID NO: 3276 - RNA, 63 nt, Homo sapiens
uggcgacagcggggaaaugagggcugaaaauauccuccccacaagggcaauccccgggaccug

SEQ ID NO: 3277 - RNA, 64 nt, Homo sapiens
uggcgcuuguuuuauuuucgauauucaaugcacuuuauguagcauugaaugaucaaauauugga

SEQ ID NO: 3278 - RNA, 62 nt, Homo sapiens
uggcuacugguguauguagcaguucuuaaaucagcaguauuaugaaaaaaaauucccccuca

SEQ ID NO: 3279 - RNA, 63 nt, Homo sapiens
uggcuagauguuuacauuuguaagaaauaacacugugaauguaaaacagagccauucccuugg

SEQ ID NO: 3280 - RNA, 61 nt, Homo sapiens
uggcucacgguuuugcaggcuguacaggaagcauggugcuaacaucugaucagcuuguagg

SEQ ID NO: 3281 - RNA, 62 nt, Homo sapiens
uggcucauuugagcauuuuggaauauuugagaauguaugauacauguaaaauuaaaaaaacu

SEQ ID NO: 3282 - RNA, 62 nt, Homo sapiens
uggcuggacuaccgagagcuuggacuacacaauacaguauuauagacaaaagaauaagacaa

SEQ ID NO: 3283 - RNA, 63 nt, Homo sapiens
uggcuguauagucauuauuaacgugucuucccucuuccccacaaggacauauaaggucauuuc

SEQ ID NO: 3284 - RNA, 62 nt, Homo sapiens
uggcuugauugcuuaaacuauugacuugguaagucuacuguauauaacaucuaauauauaua

SEQ ID NO: 3285 - RNA, 64 nt, Homo sapiens
ugggaaagguuugggggacugaacgagcauaaauaaauguagcaaaauuucuuucuaaccugcc

SEQ ID NO: 3286 - RNA, 63 nt, Homo sapiens
ugggaauggggagcaagucacgucagcucugucauuccccacaguuaacaaauuggcggggug

SEQ ID NO: 3287 - RNA, 63 nt, Homo sapiens
ugggauuacaggcgugagccaccgcgcccggccaucucagggauauuuaaacaaaggaagagg

SEQ ID NO: 3288 - RNA, 63 nt, Homo sapiens
ugggcucuuacagagccuccaugagucaagcccccuccccacaccuggacuccagaauucacc

SEQ ID NO: 3289 - RNA, 63 nt, Homo sapiens
ugggcugggccugagauucugcauuucuaaggagucucagggaugccuaugcugcuggccuaa

SEQ ID NO: 3290 - RNA, 62 nt, Homo sapiens
uggggaaauauuccaccugauaauagcccagauucuacuguauucccaaaaggcaauauuaa

SEQ ID NO: 3291 - RNA, 63 nt, Homo sapiens
uggggacauugucaccacgucgccaugacggcugguccccacaggaccagcugggaggacugg

SEQ ID NO: 3292 - RNA, 62 nt, Homo sapiens
uggggauuguggucacaugaagcucuuucugcaucaguauuaagguguauauuugaaugucc

SEQ ID NO: 3293 - RNA, 64 nt, Homo sapiens
ugggggggcgugagacccagugcacuccggucccaaauguagcagguguaaccguaacccaccc

SEQ ID NO: 3294 - RNA, 63 nt, Homo sapiens
ugggggucgaggguccugcauaugcaccuggggaguccccacacacccgcaccaaaggggaaa

SEQ ID NO: 3295 - RNA, 61 nt, Homo sapiens
uggggguucuggaccagaugaucccuuccaauguggugcuagcaggcaggaucccuucucc

SEQ ID NO: 3296 - RNA, 63 nt, Homo sapiens
ugggguauuggaaauguuuggggacuagguagaggugaauguacuaaaugccacugaauuugu

SEQ ID NO: 3297 - RNA, 62 nt, Homo sapiens
uggguagugugcauaaaguaccucugugucugaaguaugauaguugucuugaggaaaagcac

SEQ ID NO: 3298 - RNA, 62 nt, Homo sapiens
ugggucuuggguacgagaauucccucaucuuucucuacuguaaagugauuuuguuugcaggu

SEQ ID NO: 3299 - RNA, 63 nt, Homo sapiens
ugggugcccaggaguagaauaugaagugcuaaaucugaauguaagaaaaauaauaguauugaa

SEQ ID NO: 3300 - RNA, 63 nt, Homo sapiens
ugggugugaagauuaugagaguaaaguuuugaagacucagggauagcuguaaugcuuuuuucu

SEQ ID NO: 3301 - RNA, 62 nt, Homo sapiens
uggguuucugacagcccaugggaaugcccugaaacuacuguaucugauguuuguuuucgaug

SEQ ID NO: 3302 - RNA, 62 nt, Homo sapiens
ugguauaugguuaauguguaaaacaagguucuaacaguauuacugaauauuaauguuucuug

SEQ ID NO: 3303 - RNA, 62 nt, Homo sapiens
uggucaagacuaacuuucuuuuaaagguucauuuguaugauaaauucauauguguauauaua

SEQ ID NO: 3304 - RNA, 63 nt, Homo sapiens
uggucacaucacuaugccgagcaagaaaaguggaucucagggaggacuagcagccccugguua

SEQ ID NO: 3305 - RNA, 63 nt, Homo sapiens
uggucugugauuugccgacagccuugcaggcugggcucagggacaaagucccccccaaaaccc

SEQ ID NO: 3306 - RNA, 62 nt, Homo sapiens
uggugccaggggagaugguguuuuucaaagggaccuacuguagccacuuuaauuuacaauua

SEQ ID NO: 3307 - RNA, 62 nt, Homo sapiens
uggugcugcgggugcagcacggaaaccccggcuucuacuguacaggacacuggccccucuca

SEQ ID NO: 3308 - RNA, 64 nt, Homo sapiens
uggugcuuuuuaaauuuauuuuuaacuguuucucauauguagcaaccccuccuccccuccuggg

SEQ ID NO: 3309 - RNA, 62 nt, Homo sapiens
ugguggauguagcacaauuuccacacugugaaggcaguauuagaagacuuaauuguaaaagc

SEQ ID NO: 3310 - RNA, 63 nt, Homo sapiens
ugguggggaggggaggcagguguggguagcgcacauccccacagaucaaucucugcagaugac

SEQ ID NO: 3311 - RNA, 64 nt, Homo sapiens
uggugucaucuuuauguugcccacaaucccuugaacauguagcacaacuuccuuuccuuucagu

SEQ ID NO: 3312 - RNA, 63 nt, Homo sapiens
ugguuuauuuugaugaaaguucuuuuaacaugucuugaauguacacauaaaggaauccaaagc

SEQ ID NO: 3313 - RNA, 63 nt, Homo sapiens
ugguuuuaugcugcuuuguuaggacagauguguuuugaauguaccauuauaagaagaauucua

SEQ ID NO: 3314 - RNA, 63 nt, Homo sapiens
uguaaaaaaagaccuacuccuuuccuguuacccucuccccacauguaccaaccuuccuguugc

SEQ ID NO: 3315 - RNA, 63 nt, Homo sapiens
uguaaauauagcucaacacaguuauauucuuuuugugaauguauuauaucuacaauuuaccuu

SEQ ID NO: 3316 - RNA, 62 nt, Homo sapiens
uguaaauuauaaguaacuugucaaggaauguuaucaguauuaagcuaaugguccuguuaugu

SEQ ID NO: 3317 - RNA, 64 nt, Homo sapiens
uguaaccucaggaaacaguuuauuuuggguucugauauguagcaugguauuuucccuaaggcag

SEQ ID NO: 3318 - RNA, 62 nt, Homo sapiens
uguaagcuuuuauuaauacugaugacauuauaugguaugauaugaaaaaaucaccaauuuuu

SEQ ID NO: 3319 - RNA, 63 nt, Homo sapiens
uguacgggagugcucaccuccagcuacuguguccauccccacauacgaccucaucucucccac

SEQ ID NO: 3320 - RNA, 62 nt, Homo sapiens
uguagaaaguuguggcuagaucucauaaauauaacaguauuaaggccauaaaauuugguuaa

SEQ ID NO: 3321 - RNA, 62 nt, Homo sapiens
uguagaagcuuaaauauguaauguaaccaaacuccaguauuaaaaaucucucauguuguuuu

SEQ ID NO: 3322 - RNA, 61 nt, Homo sapiens
uguagcuaucuuugaaaucacuugacuuugcaauggugcuaagcugauagauuuaaauaca

SEQ ID NO: 3323 - RNA, 63 nt, Homo sapiens
uguagggcauuuucugauugcacuuccuuaaguuaugaauguacuagaaagggacucauccag

SEQ ID NO: 3324 - RNA, 64 nt, Homo sapiens
uguauagaaucagcaucucugacuaaugaaaaauggauguagcaguugaugauuuucuaucuua

SEQ ID NO: 3325 - RNA, 63 nt, Homo sapiens
uguauauuuuuuacuggaaaugagccuuuuaggaaugaauguagacugguuuguauuaaaaug

SEQ ID NO: 3326 - RNA, 62 nt, Homo sapiens
uguaucucaaaaguauugaguuuagaaaucaguuguaugauacuaccuuuguaugucugucu

SEQ ID NO: 3327 - RNA, 62 nt, Homo sapiens
uguauuauuaaauaaauaauuuucaaauguuaaacaguauuaaauggcaccugauuuugugu

SEQ ID NO: 3328 - RNA, 62 nt, Homo sapiens
uguauuucugaaucaguccgcuaauaugauugugcaguauuagcuugcuuuugcugcugugu

SEQ ID NO: 3329 - RNA, 64 nt, Homo sapiens
uguauuucugugugguuguagcaaggacucagccucauguagcacgaauaggggugugguucau

SEQ ID NO: 3330 - RNA, 61 nt, Homo sapiens
uguauuuucauugaaguaggagagauuaucagauggugcuaaagaaagugugaagaucuua

SEQ ID NO: 3331 - RNA, 61 nt, Homo sapiens
ugucaacccuccugcccuuuguggucuuagguauggugcuauagguugcaugcgucuuuau

SEQ ID NO: 3332 - RNA, 63 nt, Homo sapiens
ugucacugcugucaaacagaagguaaacagucuuaugaauguauuuccuuaggaaaacuugua

SEQ ID NO: 3333 - RNA, 61 nt, Homo sapiens
ugucaggagagauggcugaaaaggugaucaucuuggugcuaaacaaguaagaggcaacugc

SEQ ID NO: 3334 - RNA, 64 nt, Homo sapiens
ugucagguuauacuaaaacuaaaucagaaagucugaauguagcacauaaugguucucuucuguu

SEQ ID NO: 3335 - RNA, 64 nt, Homo sapiens
ugucaguuuguugucccuauuguagaugaaauagugauguagcaaaaaccuaguaaauucugaa

SEQ ID NO: 3336 - RNA, 56 nt, Homo sapiens
ugucaucuuugccuacugaccacccuuguccccacaagcagaagcacagagggguc

SEQ ID NO: 3337 - RNA, 64 nt, Homo sapiens
uguccaaaaugauucuaaauagaaucuaauaaaccaauguagcauuauuuuuuucuaaaugaag

SEQ ID NO: 3338 - RNA, 63 nt, Homo sapiens
uguccccuccccagguccuucauucaccccuccccuccccacaguggaauuguugaagugugg

SEQ ID NO: 3339 - RNA, 63 nt, Homo sapiens
ugucccugagcccccuaguccuggcuccugcuuuuuccccacagcccguguucccagccgaac

SEQ ID NO: 3340 - RNA, 63 nt, Homo sapiens
uguccucagaacaccccuccugcucccuggggcuccucagggagccauuucagcuggagucuc

SEQ ID NO: 3341 - RNA, 62 nt, Homo sapiens
ugucuauuauucauucaacucuuuuuacagaccucaguauuagucugugacuacaaaauauu

SEQ ID NO: 3342 - RNA, 62 nt, Homo sapiens
ugucucaaacaaaacaaaacaaaacaaaaacacacuacuguauuuuggauggaucaaaccuc

SEQ ID NO: 3343 - RNA, 64 nt, Homo sapiens
ugucugccccgcguuuccugccugcggaccagaugaauguagcagauccccagccucuggccuc

SEQ ID NO: 3344 - RNA, 63 nt, Homo sapiens
ugucuguaaaaaccaacaaaggcauuggacuugugugaauguacaggguuuuuuuaguaguaa

SEQ ID NO: 3345 - RNA, 62 nt, Homo sapiens
ugucuuaagaaaaguugacuguucagauauuuuucuacuguaaagaaauauacuuuucuauu

SEQ ID NO: 3346 - RNA, 63 nt, Homo sapiens
ugucuuuggugucagaacuuugggggccgggccccuccccacaauaaagaugcucuccgaccu

SEQ ID NO: 3347 - RNA, 64 nt, Homo sapiens
ugugaaacgaacacaagauuaagcuuugucagguuaauguagcauguuaaggacucuagaaaaa

SEQ ID NO: 3348 - RNA, 62 nt, Homo sapiens
ugugaaauguauuaaguugugguucuuauugaaacaguauuauauaauguuugcuuaauuau

SEQ ID NO: 3349 - RNA, 62 nt, Homo sapiens
ugugaacucaggaaugcacaguugacuugggaagcaguauuacuagaucuggaggcaaccac

SEQ ID NO: 3350 - RNA, 63 nt, Homo sapiens
ugugaacuuuuuauucuuccaaagaauuguaauccuccccacacugaagucuagggguugcga

SEQ ID NO: 3351 - RNA, 63 nt, Homo sapiens
ugugaagaaagugagcaugauucaacaguuucacucucagggauuuuaggauggcaaaauacu

SEQ ID NO: 3352 - RNA, 63 nt, Homo sapiens
ugugaagcuugcaacuuuaugucuugcuuuggacaugaauguauuacagcuugcagcuauucu

SEQ ID NO: 3353 - RNA, 61 nt, Homo sapiens
ugugaguccugagauggauuuaauucuugaugcuggugcuagaaguaggucuucaaauaug

SEQ ID NO: 3354 - RNA, 62 nt, Homo sapiens
ugugcaaaauuggcuggcugccucuguuccuacuguacuguaacuuugaucaugucuguucc

SEQ ID NO: 3355 - RNA, 62 nt, Homo sapiens
ugugcaaaugucaaauaaucuuuugcuuuaauugcuacuguacuugcuuugaaagauuaccu

SEQ ID NO: 3356 - RNA, 62 nt, Homo sapiens
ugugcaguuugaagauaguccauauuuccuauuucaguauuagguccugcaacacuuuucaa

SEQ ID NO: 3357 - RNA, 63 nt, Homo sapiens
ugugcccuuuucucucguggaagauaaaaccuggacucagggagcaaccacaggcucuccacu

SEQ ID NO: 3358 - RNA, 63 nt, Homo sapiens
ugugccuuaggaaggugugagaccggcuucccccauccccacagcaaaacacggccuguccca

SEQ ID NO: 3359 - RNA, 63 nt, Homo sapiens
ugugcguguacagguuucuaggcuguaagacugaaugaauguacauguguuuauauccucucc

SEQ ID NO: 3360 - RNA, 63 nt, Homo sapiens
uguggcaugaggaaggccgcguccgaguugaccucugaauguaugugaugagaggcagagcug

SEQ ID NO: 3361 - RNA, 63 nt, Homo sapiens
uguggcauuucugcgucuuacuggcaaccacacaacucagggaaaggaaugccugggaguggg

SEQ ID NO: 3362 - RNA, 62 nt, Homo sapiens
ugugggacagcugccuucccacgaaaguguaaagcaguauuaagaucauuacugcaugugcc

SEQ ID NO: 3363 - RNA, 63 nt, Homo sapiens
uguggggucugaugugucccuugaugggugcugcccucagggacugcacccugacaaguguua

SEQ ID NO: 3364 - RNA, 63 nt, Homo sapiens
uguggguauguagccaagagaaaugaaaacauaucuccccacaaaaaaacuuggguaugagau

SEQ ID NO: 3365 - RNA, 63 nt, Homo sapiens
ugugggugcuacuggaaaauuuauuuaauucuaacugaauguagaaacagcaacagacaugaa

SEQ ID NO: 3366 - RNA, 63 nt, Homo sapiens
uguggucaggacugagcaggggacuggcccuccccuccccacagcugcucuacagggaccacg

SEQ ID NO: 3367 - RNA, 63 nt, Homo sapiens
uguguaaagcuguucaaguuauuugauguuuacaccucagggaaagucuuguguucagcaaua

SEQ ID NO: 3368 - RNA, 62 nt, Homo sapiens
uguguauuuauacccccaggaaacuagcuuuugccaguauuaugcauauauaaguuuacacc

SEQ ID NO: 3369 - RNA, 63 nt, Homo sapiens
ugugucccuucucccccgugccccuugaugcccccuccccacagugcucaggagacccguggg

SEQ ID NO: 3370 - RNA, 62 nt, Homo sapiens
ugugucuggauauuaacucuuguuuaaacugaauguaugauauuuuguuagaauggaaaagu

SEQ ID NO: 3371 - RNA, 63 nt, Homo sapiens
ugugugagaaaagaauagaagugaaauuugcauaaugaauguaaaagggaaauaaaagucuuu

SEQ ID NO: 3372 - RNA, 55 nt, Homo sapiens
uguguuggaucugaggugauuauguucugaauguaagcaccgucaacaucagaca

SEQ ID NO: 3373 - RNA, 61 nt, Homo sapiens
uguguuuuccucacacacuuugauuuggagaauuggugcuaguuggcaauagauaacucag

SEQ ID NO: 3374 - RNA, 63 nt, Homo sapiens
uguuacucugguucuuuguuuuaaaauaaaaauucugaauguacacgcgugccuccuuccacc

SEQ ID NO: 3375 - RNA, 64 nt, Homo sapiens
uguuagguaauuaaagguauguaaacaaauuaucucauguagcaggggauuuucauguugagag

SEQ ID NO: 3376 - RNA, 64 nt, Homo sapiens
uguuagugacccacaggacaguauagauguuuguggauguagcacugaguggugauacccagac

SEQ ID NO: 3377 - RNA, 62 nt, Homo sapiens
uguucacaacuuccauaagauacugcuaaugcaccaguauuaaaacacaucgacguaaguag

SEQ ID NO: 3378 - RNA, 63 nt, Homo sapiens
uguucagagaauuccucucauuaaggaaauauuuuuccccacaauugucugauguaugagucc

SEQ ID NO: 3379 - RNA, 63 nt, Homo sapiens
uguucccaucugaagagguagccccgggagaggcccucagggaccgacccagaccagcaagcu

SEQ ID NO: 3380 - RNA, 64 nt, Homo sapiens
uguucccaugcuguuucuugugaaaugcucucggcuauguagcagcuuuugauucccugcauac

SEQ ID NO: 3381 - RNA, 63 nt, Homo sapiens
uguuccuaagacccuugucccagauacucuaaaugugaauguaugagcugggggagucaaccc

SEQ ID NO: 3382 - RNA, 61 nt, Homo sapiens
uguucuagucuguugcgcuguuacaaucuguauuggugcuagucagaaaauuccuagcuca

SEQ ID NO: 3383 - RNA, 63 nt, Homo sapiens
uguucucuguagcucaaucugcaaacaugccaggccucagggauccucugcugggugccuccu

SEQ ID NO: 3384 - RNA, 63 nt, Homo sapiens
uguucugaaaauauggugaugguugcacaccauugugaauguacugaaugccauucaguggua

SEQ ID NO: 3385 - RNA, 63 nt, Homo sapiens
uguucugcauugagccuaguuuugccauuguccccugaauguaguauuaucuauagauuauac

SEQ ID NO: 3386 - RNA, 63 nt, Homo sapiens
uguucuggaaucuuaugcccaggguuuuucacuucuccccacaucucccuuuccacuugccag

SEQ ID NO: 3387 - RNA, 63 nt, Homo sapiens
uguugaaauguuggguuaaaauuguguuuuauaacauguagcacacuguaucuaaagacauau

SEQ ID NO: 3388 - RNA, 63 nt, Homo sapiens
uguugagggaacagacaggagaaaugcauccauuccucagggacagagacaccugcaccuccc

SEQ ID NO: 3389 - RNA, 62 nt, Homo sapiens
uguugaucgacauuuggguuguuuccccuuuuggcuacuguaaauagugcuucuaggaagag

SEQ ID NO: 3390 - RNA, 63 nt, Homo sapiens
uguugcuucuguugucaccuccaacaaaagggcaacucagggaaccuacagccccagccguca

SEQ ID NO: 3391 - RNA, 62 nt, Homo sapiens
uguugguuagaagcauagguaacugauuaaguagguaugauacugcauuugaaauaagugga

SEQ ID NO: 3392 - RNA, 64 nt, Homo sapiens
uguuguaugauuuauacuaagcauuaauguggcucuauguagcaaaucaguuauucauguaggu

SEQ ID NO: 3393 - RNA, 61 nt, Homo sapiens
uguuguccggagccagcucacugucuuccacacuggugcuaacuggcccaggcacuggagu

SEQ ID NO: 3394 - RNA, 63 nt, Homo sapiens
uguuuaagauauguuuggugaccaaaacguaugugugaauguaguuauaaugcuuuugaaaaa

SEQ ID NO: 3395 - RNA, 63 nt, Homo sapiens
uguuuaaggcucuucauccugguuagcaaaaggugugaauguaaugugauggaauuuaaaagu

SEQ ID NO: 3396 - RNA, 63 nt, Homo sapiens
uguuuagagagccugucaccagagcuucucugggcugaauguaugucagugcuauaaaugcca

SEQ ID NO: 3397 - RNA, 63 nt, Homo sapiens
uguuuagggccuuaagccccugaggguccuggugacucagggaauccaucacagccccggguc

SEQ ID NO: 3398 - RNA, 63 nt, Homo sapiens
uguuuaguaaaucccuucaguauuuaucccuccuuuccccacagcagcuuucuuuccugucaa

SEQ ID NO: 3399 - RNA, 61 nt, Homo sapiens
uguuuauuaaaaaaauggaacuguacacuuguuuggugcuaauuaauacaucaaaauauac

SEQ ID NO: 3400 - RNA, 62 nt, Homo sapiens
uguuugugcagauuaccaaauuacugcugauguaguaugauaaagucagcuucuuggauaca

SEQ ID NO: 3401 - RNA, 63 nt, Homo sapiens
uguuuuaauaugucaguuauugcccuuuuauauugugaauguaaugugcauaagcuauauccg

SEQ ID NO: 3402 - RNA, 63 nt, Homo sapiens
uguuuuguagccuuaagaaguguuucaaacauaucugaauguauaaaauaagaguaaaugccc

SEQ ID NO: 3403 - RNA, 62 nt, Homo sapiens
uguuuuguuugauaaaguaugcuuauuucugugccuacuguauaaugguuaucaaacaguug

SEQ ID NO: 3404 - RNA, 63 nt, Homo sapiens
uguuuuuaauaaguguacuuuuuuuccccccuccgugaauguagaucauaagcaaacaaauug

SEQ ID NO: 3405 - RNA, 62 nt, Homo sapiens
uguuuuuauacacucuaagaaauguguuuauaaucuacuguaauuuccacuaaauggaaccc

SEQ ID NO: 3406 - RNA, 61 nt, Homo sapiens
uguuuuuuauacaaacacucgcaauccgacauuuggugcuaaggguuuccuggugcagacg

SEQ ID NO: 3407 - RNA, 63 nt, Homo sapiens
uuaaaaaaaaauaauaauaaucuggugccucaguuuccccacaugugcaaugggauacuuauu

SEQ ID NO: 3408 - RNA, 63 nt, Homo sapiens
uuaaaaacacacugaaagaaaaacucugaauguaaggaauguggaaaucuuuuaggaauuucu

SEQ ID NO: 3409 - RNA, 63 nt, Homo sapiens
uuaaaaacuuguauaguugucuagauuucugcaccugaauguauguuugaugcuuugauuuga

SEQ ID NO: 3410 - RNA, 63 nt, Homo sapiens
uuaaaacaaugaaagagcauuuaucguuugucccuugaauguagaauuuguuuuugauuucau

SEQ ID NO: 3411 - RNA, 62 nt, Homo sapiens
uuaaaauugaaauuaguuauuuucuucugcuggacaguauuaaauagagcaggauguugagu

SEQ ID NO: 3412 - RNA, 63 nt, Homo sapiens
uuaaacaucagauaauucauaugggagaaaccuuaugaauguaauaaaugugggaaaucuuuu

SEQ ID NO: 3413 - RNA, 63 nt, Homo sapiens
uuaaaggucuacuuuaaucagaaauagcaacgagaugaauguauccaacauuucaauuugcau

SEQ ID NO: 3414 - RNA, 62 nt, Homo sapiens
uuaaaguucuccuuccgucuuuucucccauuuuacaguauuacucaaauaagggcacacagu

SEQ ID NO: 3415 - RNA, 62 nt, Homo sapiens
uuaaaucauucuuguugaacaguuuuuguauguacaguauuaugguacuuuuuuuuuuuuag

SEQ ID NO: 3416 - RNA, 63 nt, Homo sapiens
uuaaauuuuagucagauuuugcccaaccuaaugcucucagggaaagccucuggcaaguagcuu

SEQ ID NO: 3417 - RNA, 62 nt, Homo sapiens
uuaacugugcaaaauuggcuggcugccucuguuccuacuguacuguaacuuugaucaugucu

SEQ ID NO: 3418 - RNA, 63 nt, Homo sapiens
uuaaggacagugguuaugacaugggggccuugaaccucagggacagagguggcuggggcuuaa

SEQ ID NO: 3419 - RNA, 61 nt, Homo sapiens
uuaaggugacuggauauguaaagucguuuaauguggugcuaaaaaguaaaggacuuuuaau

SEQ ID NO: 3420 - RNA, 62 nt, Homo sapiens
uuaaguuauaaggugaaucaaacaauauguaauacaguauuaggauguaaucuuugcuuuug

SEQ ID NO: 3421 - RNA, 61 nt, Homo sapiens
uuaauaguauuucagauacuugaagaauguugauggugcuagaagaauuugagaagaaaua

SEQ ID NO: 3422 - RNA, 62 nt, Homo sapiens
uuaauagugaggaagccuauuugaacuacuuaaacaguauuaaagcccuuuuuaaaaagcac

SEQ ID NO: 3423 - RNA, 62 nt, Homo sapiens
uuaauauguacacauauauucacuacauauguauguaugauauauucauauauacaugcagu

SEQ ID NO: 3424 - RNA, 63 nt, Homo sapiens
uuaauauuugacauguuugguguucucugaccuguuccccacacuggggauuccuggucugua

SEQ ID NO: 3425 - RNA, 62 nt, Homo sapiens
uuaaugacgguuuaaaacuuuuuaaaagaaaacucaguauuauuuuugcauguuuucuaacc

SEQ ID NO: 3426 - RNA, 62 nt, Homo sapiens
uuaaugcuguuuuaaugggguugaaaacaagcagcuacuguauguauguagcuaacugaauu

SEQ ID NO: 3427 - RNA, 63 nt, Homo sapiens
uuaauguaaacagaacuggcacacacacauuaagaugaauguaauuauuauuccucuugcugg

SEQ ID NO: 3428 - RNA, 61 nt, Homo sapiens
uuaauguuaauguauggaaauucaacuaauuuuuggugcuauuauucuauucugcaaauac

SEQ ID NO: 3429 - RNA, 63 nt, Homo sapiens
uuaauguugagcuaagaagcauuaagucuuugaacugaauguauuuugcaucccugguuuugg

SEQ ID NO: 3430 - RNA, 62 nt, Homo sapiens
uuaauuaaaauuaaaauuuuaugauauuuuauuucuacuguauuuugcuguauucauucugc

SEQ ID NO: 3431 - RNA, 62 nt, Homo sapiens
uuaauugcuuuuguuuaaaauuugaucgccuuaacuacuguaaacauagccuauuuuugugc

SEQ ID NO: 3432 - RNA, 61 nt, Homo sapiens
uuaauuucuaaagauuaaaaaaagcaaaaaaauuggugcuaaaccuucaccccugagcacg

SEQ ID NO: 3433 - RNA, 63 nt, Homo sapiens
uuacaauugugaaaaccucauggauuugggcaaacugaauguauauaggcuuuugacaaaagu

SEQ ID NO: 3434 - RNA, 64 nt, Homo sapiens
uuacacccacauacaguccuuggcucagugcuaggcauguagcaggugcugacugccucucucc

SEQ ID NO: 3435 - RNA, 63 nt, Homo sapiens
uuacaguguaguguuuauucuaaggaagauauguaugaauguauauacaaagacucagcuacu

SEQ ID NO: 3436 - RNA, 63 nt, Homo sapiens
uuacauuugaguaugguaacuuaugucaucuauguugaauguaagcuuauaaagcacaaagca

SEQ ID NO: 3437 - RNA, 61 nt, Homo sapiens
uuaccccaucauacugauuucuuucuugggcacuggugcuacuuggugccaagaaucaugu

SEQ ID NO: 3438 - RNA, 63 nt, Homo sapiens
uuacccucauauucuuuaaaaaacuuaaagcauuaugaauguagagaaauucaccagagcuca

SEQ ID NO: 3439 - RNA, 62 nt, Homo sapiens
uuacccucuguaagauacugauucuuccuggggccaguauuaccuuguaugcaaauauuaca

SEQ ID NO: 3440 - RNA, 63 nt, Homo sapiens
uuacgagcaagugccggcuggacccaagcccugcauccccacaugcggggcagaggcccuucu

SEQ ID NO: 3441 - RNA, 63 nt, Homo sapiens
uuacuaguuucuugaauuguucuuguggacuuuuccucagggauacauuggccugcagguccc

SEQ ID NO: 3442 - RNA, 62 nt, Homo sapiens
uuacuucuuuguuuagaauggaauuuccuaugcacuacuguagcuaggaaaugcugaaaaca

SEQ ID NO: 3443 - RNA, 61 nt, Homo sapiens
uuacuugaggugugccuuguauaacugaauuuauggugcuauuuaaacaauuuuuuucuaa

SEQ ID NO: 3444 - RNA, 62 nt, Homo sapiens
uuagaaaggaggcuguagaauauuugccgagccucuacuguauaccaggggcuaacucacca

SEQ ID NO: 3445 - RNA, 62 nt, Homo sapiens
uuagaaguugauucccaggagugccauauuucagcuacuguauuuccuuuuucuuguaaugu

SEQ ID NO: 3446 - RNA, 62 nt, Homo sapiens
uuagaaugcugaaauguuuuugaaguuaaauaaacaguauuacauuuuuaaaacucuucucu

SEQ ID NO: 3447 - RNA, 63 nt, Homo sapiens
uuagaggguaguauaaaugagcacagugcacauuguccccacacaccugaauuuucagucacu

SEQ ID NO: 3448 - RNA, 63 nt, Homo sapiens
uuagaguugucuuucagcauucaaucaggcugagcugaauguagugauguuuacauuguuuac

SEQ ID NO: 3449 - RNA, 63 nt, Homo sapiens
uuagcagcucaauuuguacuacuucagccaaucugugaauguaaaaacuacacuguugccuug

SEQ ID NO: 3450 - RNA, 63 nt, Homo sapiens
uuagccaaaaaccacacaaaacaaaaauaauccccuccccacaggaauaugcuuuccaaauug

SEQ ID NO: 3451 - RNA, 63 nt, Homo sapiens
uuagccacaauggccccccgcgaagugagucauacuccccacaagucucugggcugggcagcc

SEQ ID NO: 3452 - RNA, 62 nt, Homo sapiens
uuaggaaaaauaaaauuucuaauuauuauuuuuaguaugauauuuuuaacaagagucuauag

SEQ ID NO: 3453 - RNA, 62 nt, Homo sapiens
uuaggggaaaucaaaucugguugguaggugucuacaguauuagaagaggguauaagggcacu

SEQ ID NO: 3454 - RNA, 62 nt, Homo sapiens
uuaggugaauugaguagaggguucauuccaauuccuacuguauaggugucugugucucaaaa

SEQ ID NO: 3455 - RNA, 62 nt, Homo sapiens
uuagucuaaagaauugagacuaccguaauugagacuacuguagugacaucugagaaauggga

SEQ ID NO: 3456 - RNA, 61 nt, Homo sapiens
uuaguuaauagcauugggauauagucacuguaauggugcuauuaacaaacagucaacacca

SEQ ID NO: 3457 - RNA, 64 nt, Homo sapiens
uuaguuagaugauaaaccaggguuuuaaaucaaacaauguagcauaaagugguauugaaguacc

SEQ ID NO: 3458 - RNA, 64 nt, Homo sapiens
uuauaaacaaaaauacauaaagcuuugaauauaauuauguagcauaaaaguuaagguuguucac

SEQ ID NO: 3459 - RNA, 63 nt, Homo sapiens
uuauaaauugugauguagccucgcuagucaagcugugaauguauauuguuugcacuuaauccu

SEQ ID NO: 3460 - RNA, 63 nt, Homo sapiens
uuauaacccuguuuccccucagagaagagcuauggcucagggaucuguguugacucuggcauu

SEQ ID NO: 3461 - RNA, 63 nt, Homo sapiens
uuauacguuaagaccucuaugaaugaauguaucagagaaugucuuuguaacuguuuaauucaa

SEQ ID NO: 3462 - RNA, 63 nt, Homo sapiens
uuauagauauaggacaguacuguaucauaccucugugaauguaaaauaucuuguaccugcuuu

SEQ ID NO: 3463 - RNA, 64 nt, Homo sapiens
uuauaugaaacuacuaaagacuuuuuaaauggcuugauguagcagucauagcaaguuuguaaau

SEQ ID NO: 3464 - RNA, 62 nt, Homo sapiens
uuauaugcauuuuuguagggaucagcuugguagacaguauuagcggagaaacaccuugaucu

SEQ ID NO: 3465 - RNA, 63 nt, Homo sapiens
uuaucacuccacuuuuucagacaaggaaacugaggcucagggaagccaagugacaaguccaag

SEQ ID NO: 3466 - RNA, 62 nt, Homo sapiens
uuaucacuguaauggaauauccaauuuacagauaguaugauauacauuucaucauuuaagua

SEQ ID NO: 3467 - RNA, 64 nt, Homo sapiens
uuaucaggcauuuucauuuggaaauuucauuauugaauguagcaagguuguaguuguuuuuuuu

SEQ ID NO: 3468 - RNA, 61 nt, Homo sapiens
uuaucccgaaaaaguguacauagaucuaaaauuuggugcuauguguauaucuugagcuuuu

SEQ ID NO: 3469 - RNA, 61 nt, Homo sapiens
uuauccuauuuucuaccauuaucuauguuuucauggugcuauuaauuacaaguuuaguucu

SEQ ID NO: 3470 - RNA, 62 nt, Homo sapiens
uuaucgggaguuccuuauuuaucacuagcagagaguaugauacaauuuucaaaugugaacaa

SEQ ID NO: 3471 - RNA, 63 nt, Homo sapiens
uuaucugaaagaaguuucuggguuaggagaaguaaugaauguauccauuuguacaugguuuac

SEQ ID NO: 3472 - RNA, 62 nt, Homo sapiens
uuaucuuacugguucaacauuuuucugauauaugcaguauuacagauauucagcaaaaguau

SEQ ID NO: 3473 - RNA, 63 nt, Homo sapiens
uuaugaagaaagauacuaauagaguacuuaauauacucagggauuccuucuaaguguacuuca

SEQ ID NO: 3474 - RNA, 64 nt, Homo sapiens
uuaugccauaaaagaccaacccaguucuguuugacuauguagcaucuugaaaagaaaaauuaua

SEQ ID NO: 3475 - RNA, 63 nt, Homo sapiens
uuaugcucuggcaucuaacauaugauucuguaguaugaauguaaucaguguauguuaguacaa

SEQ ID NO: 3476 - RNA, 63 nt, Homo sapiens
uuaugguauuuauuuucaguaguaaagacccagcuugaauguaaauuuuguauaguguaagua

SEQ ID NO: 3477 - RNA, 52 nt, Homo sapiens
uuaugguuucggcgguugaggcuguccccacagcuucucuacagacuccaaa

SEQ ID NO: 3478 - RNA, 64 nt, Homo sapiens
uuaugugguaugaauuaacuuugaacauguugaaauauguagcaugucuuuaacucagacgaag

SEQ ID NO: 3479 - RNA, 64 nt, Homo sapiens
uuauuaucagauggggcaacauauuguaugaagcauauguagcacuucacagcaugguuaucau

SEQ ID NO: 3480 - RNA, 63 nt, Homo sapiens
uuauuccucuuuaucguuuucugugguuucuaaauuccccacaauaauaaguauguguugcuc

SEQ ID NO: 3481 - RNA, 62 nt, Homo sapiens
uuauuccugcuuucguguuacuuuuaauaaauaacuacuguacucaauacucuaaagcuuga

SEQ ID NO: 3482 - RNA, 62 nt, Homo sapiens
uuauugacaaguuaaaauagcacucucaguuuuucaguauuacagagagcaaauaguuuccu

SEQ ID NO: 3483 - RNA, 61 nt, Homo sapiens
uuauugcuuucggcaguaaggggguuuguuugauggugcuaucagagggggaaaggcaagg

SEQ ID NO: 3484 - RNA, 64 nt, Homo sapiens
uuauugucuugguugccaguaguaccuuguuuugccauguagcagacaacacacaaaauaaugc

SEQ ID NO: 3485 - RNA, 62 nt, Homo sapiens
uuauuuuauaacugauuuuuaaaaugcuguuuuucaguauuaacuauguugaccuuagaaaa

SEQ ID NO: 3486 - RNA, 62 nt, Homo sapiens
uuauuuuauuauuauuaguaguagcagcaacagaguaugauaugacccaaaagccauuguaa

SEQ ID NO: 3487 - RNA, 62 nt, Homo sapiens
uuauuuucuguacuuuuuuguucauuaauuuugucaguauuacaccaaacuguuuuugcaac

SEQ ID NO: 3488 - RNA, 63 nt, Homo sapiens
uuauuuuuugucucuuuuaagaugguaaaaugguucucagggauuccugccaauacuuugaau

SEQ ID NO: 3489 - RNA, 62 nt, Homo sapiens
uucaaaauucuguaaaagugguugcucaaaagauguaugauacuauuuuaaucaguuuaaga

SEQ ID NO: 3490 - RNA, 62 nt, Homo sapiens
uucaaaguauauacagagccuguuuuaaaaaauacaguauuauuuaguaaaauuaucuguuc

SEQ ID NO: 3491 - RNA, 63 nt, Homo sapiens
uucaacaucagagcauucauaccaaagagaacucaugaauguaaugaagaugggaagauauuu

SEQ ID NO: 3492 - RNA, 62 nt, Homo sapiens
uucaaccugcuucccagguggcccugaugcaccccaguauuagaguuuauugcuaaaaggaa

SEQ ID NO: 3493 - RNA, 62 nt, Homo sapiens
uucacaauuugcuguaacccuuaacuuaaauagccaguauuaucuugcccuuuugaacauuu

SEQ ID NO: 3494 - RNA, 62 nt, Homo sapiens
uucaccacucaugcuacuaaucaucuaccugcuacuacuguaaaccaugguuccagcagccu

SEQ ID NO: 3495 - RNA, 62 nt, Homo sapiens
uucacggggaaugcuuccagcuuuugcccauucaguaugauauuaucuguggguuucucaua

SEQ ID NO: 3496 - RNA, 62 nt, Homo sapiens
uucacguucuaguguuuuuccugaaaugugcaaucuacuguauaguauugccacauaauugu

SEQ ID NO: 3497 - RNA, 62 nt, Homo sapiens
uucacuuugcuguuguagauagccagucaaccagcaguauuagugcuguuuucaaagauuua

SEQ ID NO: 3498 - RNA, 63 nt, Homo sapiens
uucagaaguauauagauacuuccggugacuacauaugaauguacuuucaauauuauuuuuuua

SEQ ID NO: 3499 - RNA, 62 nt, Homo sapiens
uucagaucuuuuuacagaaugaacuuaugcacugcuacuguaguauucucaaggaauauaug

SEQ ID NO: 3500 - RNA, 63 nt, Homo sapiens
uucagauuucuuguucuauggaagaggaagcugagcucagggagauaugagcuccacagccac

SEQ ID NO: 3501 - RNA, 63 nt, Homo sapiens
uucaggcagauuaaaagaaucauuuguugaacaacugaauguauaaaaaaauuauaaacuggu

SEQ ID NO: 3502 - RNA, 63 nt, Homo sapiens
uucaggcuugacaacuucacauugccucucuuccuugaauguauuuuaucuggucuuuucuau

SEQ ID NO: 3503 - RNA, 61 nt, Homo sapiens
uucagggaugucgugggcgggggaggggguucuuggugcuacagcccucuccccaccccua

SEQ ID NO: 3504 - RNA, 62 nt, Homo sapiens
uucaggucuuccaacuaugcccuuggauuguggccuacuguauguuauuaaauggucucuua

SEQ ID NO: 3505 - RNA, 63 nt, Homo sapiens
uucagugugggcugcugaagcuauccuccucaggccucagggaugaccuccugccugagccuc

SEQ ID NO: 3506 - RNA, 62 nt, Homo sapiens
uucauaaugggaaaucuuuuucauuugagaaauuguaugauauuuauugguugugucuacug

SEQ ID NO: 3507 - RNA, 63 nt, Homo sapiens
uucaugacaccuggggccucggggucuggagcgagcucagggaggccccacagaguguggggg

SEQ ID NO: 3508 - RNA, 64 nt, Homo sapiens
uucauguuugcuuuuguuuuguuuuguuuuuaauguauguagcagauguuacagucuuagggau

SEQ ID NO: 3509 - RNA, 63 nt, Homo sapiens
uucauugaugaccauaucuccagggauguuguugauccccacacugccuuaagguauauuaua

SEQ ID NO: 3510 - RNA, 63 nt, Homo sapiens
uucauuuuuacuuuuucuuauuuuuaaaauuaggcugaauguacuucaugugauuugucaacc

SEQ ID NO: 3511 - RNA, 64 nt, Homo sapiens
uuccaaaauauauuauaacaaacauucuauaucgguauguagcagaccaaucucuaaaauagcu

SEQ ID NO: 3512 - RNA, 64 nt, Homo sapiens
uuccaauauuaguuggaguuaacuugaauugauuguauguagcacagcacuuuugcaguaagau

SEQ ID NO: 3513 - RNA, 63 nt, Homo sapiens
uuccacaaaauuggaagcuuuuuuuaaaaauguuuuccccacaagucaucuugccuuguggca

SEQ ID NO: 3514 - RNA, 63 nt, Homo sapiens
uuccacgacuaccaccaucucaaguaaggaccuucuccccacaaugggucccuaggcaacaac

SEQ ID NO: 3515 - RNA, 62 nt, Homo sapiens
uuccacucagcuugguuccugcccccgcccugcuguaugauauuaauguggaaggucaucaa

SEQ ID NO: 3516 - RNA, 64 nt, Homo sapiens
uuccacuuuaacuuuguuuuugcauuugaagaauguauguagcacuuuccuauauauuugucac

SEQ ID NO: 3517 - RNA, 63 nt, Homo sapiens
uuccagaaaauguugugucugaugcagcuucucagugaauguagguuguuggugaaauuuuca

SEQ ID NO: 3518 - RNA, 62 nt, Homo sapiens
uuccagauuaccaaucaauuaaucaacaaauagccaguauuaugcuguguauuucugucagg

SEQ ID NO: 3519 - RNA, 62 nt, Homo sapiens
uuccaguuaucucguggaaugacagauugugccuguaugauaucaggcacaauuaaugcaaa

SEQ ID NO: 3520 - RNA, 63 nt, Homo sapiens
uuccauaucagcugcugcuagcgccagcgcagacucucagggagucaccacagcuugucuugu

SEQ ID NO: 3521 - RNA, 62 nt, Homo sapiens
uucccaagaagagagaacuuuuucgauaaacuaacuacuguagaagaagugaacacuuaccu

SEQ ID NO: 3522 - RNA, 61 nt, Homo sapiens
uucccauuuauuguuuggccagcuaugccaauguggugcuauuguuucuuuaagaaaguac

SEQ ID NO: 3523 - RNA, 63 nt, Homo sapiens
uucccauuucaacaaaaaccaaaauacugauuguuugaauguagaaagguauagaauaaagac

SEQ ID NO: 3524 - RNA, 63 nt, Homo sapiens
uuccccaccuccuucccaaacccucuugggaacuccucagggacaacuacugcugaguuuggg

SEQ ID NO: 3525 - RNA, 63 nt, Homo sapiens
uuccccagcggccaccaacugaccuggggcgcugcuccccacaguccaaauaagcugaaagug

SEQ ID NO: 3526 - RNA, 63 nt, Homo sapiens
uucccuccccuuccuccaaaacccucccucccaccuccccacacccauugagucauucacagg

SEQ ID NO: 3527 - RNA, 61 nt, Homo sapiens
uucccuggcuuauuucauccuggucuugggguauggugcuagcuaugguaagggaaaggga

SEQ ID NO: 3528 - RNA, 63 nt, Homo sapiens
uuccgugguuaaacucgcucacugcuaagaauauuugaauguaugcuucauacagggauggug

SEQ ID NO: 3529 - RNA, 62 nt, Homo sapiens
uuccuacugcuuggaguagcuguacugguaaauacuacuguaggaguaucugcuuguuaaaa

SEQ ID NO: 3530 - RNA, 61 nt, Homo sapiens
uuccucaucuccaacuaugugacauaauuuauuuggugcuaauauugaaguaauauuuauu

SEQ ID NO: 3531 - RNA, 61 nt, Homo sapiens
uuccucuguucaaagcugccugucccuaccccauggugcuaggaagaggagugggguggug

SEQ ID NO: 3532 - RNA, 62 nt, Homo sapiens
uuccugaguucuuccucucaaaauuucugugcaccaguauuauuccucauuuuacauacagg

SEQ ID NO: 3533 - RNA, 63 nt, Homo sapiens
uuccuuccucucacgguuuuuugcagaagcaagugcucagggaaaugaagacaggagaacugc

SEQ ID NO: 3534 - RNA, 64 nt, Homo sapiens
uucggaucuguguccccacccaaaucuuaugucaaaauguagcacuaaugugggagguggggca

SEQ ID NO: 3535 - RNA, 62 nt, Homo sapiens
uucuaagugcucaguagcucugugugaccagcggcuacuguauuggauauuauagaagguuc

SEQ ID NO: 3536 - RNA, 63 nt, Homo sapiens
uucuacucuucuaagcuuacagagaccagaccaggugaauguaacuggggaaaaucaagaugg

SEQ ID NO: 3537 - RNA, 63 nt, Homo sapiens
uucuagagcaaggaauugacuuuuaggagccguucuccccacaagacaccacaugacaagggg

SEQ ID NO: 3538 - RNA, 63 nt, Homo sapiens
uucuaguuuaaaggaaacagaagagauaugacagcugaauguaaugugcaauggaugauuaaa

SEQ ID NO: 3539 - RNA, 62 nt, Homo sapiens
uucuauucgaggauuuuauaauggcauauuuuuucaguauuaaagcgaaaauguuuucaacu

SEQ ID NO: 3540 - RNA, 61 nt, Homo sapiens
uucuauuuauuuucuacaucuggccaguggcucuggugcuagaugccacuguagccagauc

SEQ ID NO: 3541 - RNA, 61 nt, Homo sapiens
uucuccccgcacauacucacggaaaggaaccaauggugcuauuuccccucucuccuccuca

SEQ ID NO: 3542 - RNA, 62 nt, Homo sapiens
uucucuaguuugauuaaauucuugcaaaguaucccuacuguaauuugugauacaaugcugug

SEQ ID NO: 3543 - RNA, 61 nt, Homo sapiens
uucucuauaggaagccauagcacuccuaauguuuggugcuauguuuuccugaggagauaua

SEQ ID NO: 3544 - RNA, 63 nt, Homo sapiens
uucucucucuuuuugaauuucaaagaagaaacagucucagggaaauuucuuuuuucuuuuuuu

SEQ ID NO: 3545 - RNA, 62 nt, Homo sapiens
uucucuuuugucuacaaaucacugaacucagguacuacuguaggcaguuuccuccucagucu

SEQ ID NO: 3546 - RNA, 63 nt, Homo sapiens
uucucuuuuuuuagauauuuuucuaucucucacuucucagggaugaaauucuuuuucaaaguu

SEQ ID NO: 3547 - RNA, 63 nt, Homo sapiens
uucugcuuuaaaggcauguguguuuuuaaaauuaaugaauguagaugugugauugucugagug

SEQ ID NO: 3548 - RNA, 63 nt, Homo sapiens
uucugucaaggaauuacaaguagcaagggaaggucugaauguaaggacaggccuagggaccuu

SEQ ID NO: 3549 - RNA, 63 nt, Homo sapiens
uucuguccacggggucucuccuuccuccucccuagcucagggaugggccuuccagccggagca

SEQ ID NO: 3550 - RNA, 63 nt, Homo sapiens
uucuguggguuugggugggaagagggccaucugccugaauguaaccugcuagcucuccgaagg

SEQ ID NO: 3551 - RNA, 62 nt, Homo sapiens
uucuuccauuaauuacauguguaaaauuaaaacacuacuguaauguuaauuuccugguuuug

SEQ ID NO: 3552 - RNA, 62 nt, Homo sapiens
uucuugagcaaucgcucgguccguggacaauaaacaguauuaucaaagaggccuccaacgcc

SEQ ID NO: 3553 - RNA, 62 nt, Homo sapiens
uucuugauuaugcuacuggugcaauuggaucaguguaugauauggaugaugaugaaauggac

SEQ ID NO: 3554 - RNA, 63 nt, Homo sapiens
uucuugcuucuucuaccuuuauuuauucucagcucugaauguaugaaccugcucaaucaccuc

SEQ ID NO: 3555 - RNA, 62 nt, Homo sapiens
uucuuggagagcauuccuuguaguuaagcagggacuacuguauucuguugagcuuucacaug

SEQ ID NO: 3556 - RNA, 63 nt, Homo sapiens
uucuuuaccuggucuccuuccuucgucuagaaccuuccccacaguagcuaauccuaacaacuu

SEQ ID NO: 3557 - RNA, 63 nt, Homo sapiens
uucuuuucccagaagagucuuugauucaccaaacaugaauguacauuuucuaacaaacucaaa

SEQ ID NO: 3558 - RNA, 63 nt, Homo sapiens
uugaaaagaaaaauaccggggccagggagaagccgugaauguauuuauuugcuuuggugaagc

SEQ ID NO: 3559 - RNA, 62 nt, Homo sapiens
uugaaaauauuuaaauauugcacuucuauaaauaguaugauaaaugcacagacaauugcagu

SEQ ID NO: 3560 - RNA, 63 nt, Homo sapiens
uugaacagcauggaaucucauugccaaauuauuagugaauguauaguucagguauucuuugag

SEQ ID NO: 3561 - RNA, 63 nt, Homo sapiens
uugaaucugucacucuuccacuagaaaccuuaguguccccacaugaggaaagcacuucauuau

SEQ ID NO: 3562 - RNA, 63 nt, Homo sapiens
uugacaucugucaucaguauuuagagggugagaagugaauguaacagguauaaauaacauuuu

SEQ ID NO: 3563 - RNA, 63 nt, Homo sapiens
uugagaaaaacaaugagcugagaggcagacuucccugaauguauugaacuuggaaagaaaugc

SEQ ID NO: 3564 - RNA, 62 nt, Homo sapiens
uugagaaacagcuacagcuuugggucauuuuuaacuacuguauucccacaaggaauccccag

SEQ ID NO: 3565 - RNA, 63 nt, Homo sapiens
uugauaauugcuuuauaauuccuugguaaugacagcucagggaagguuucacaaggucaugau

SEQ ID NO: 3566 - RNA, 63 nt, Homo sapiens
uugaucuucaggaugcacgguuucuguucugcccccucagggaugugggaaucucccagacuu

SEQ ID NO: 3567 - RNA, 62 nt, Homo sapiens
uugaucuuuuucaagucuucugaaaggaaguagacaguauuacacccugaauaaauaaggug

SEQ ID NO: 3568 - RNA, 63 nt, Homo sapiens
uugaugccaguaaucuauaagggaucuuuauaguuugaauguauuugaauaacuucaguauac

SEQ ID NO: 3569 - RNA, 62 nt, Homo sapiens
uugaugucagguauuuacagugguuggaagauagcaguauuauuagcauaagcugcauacgu

SEQ ID NO: 3570 - RNA, 63 nt, Homo sapiens
uugauuaguuauuauugcaaagcacugucaccggccucagggaguuuauguguaauagaauua

SEQ ID NO: 3571 - RNA, 63 nt, Homo sapiens
uugauucuuggucuauaauugcagauguuauuguaugaauguaccauaauauauuugagcagu

SEQ ID NO: 3572 - RNA, 63 nt, Homo sapiens
uugcaggaagccaggauguaauucucagaaccagucucagggagauauaugcuuggagaacuc

SEQ ID NO: 3573 - RNA, 62 nt, Homo sapiens
uugccccuguauccuguaaauguugauuuaucaucuacuguaagcgaggcacuguuguaagc

SEQ ID NO: 3574 - RNA, 63 nt, Homo sapiens
uugcccugcaaauaaaaagacaauuccuuauugucugaauguaauacagucuucauuguacua

SEQ ID NO: 3575 - RNA, 63 nt, Homo sapiens
uugcggcugcuggcaggacugagcuguccggguucuccccacacuuccagcacagcugugcuc

SEQ ID NO: 3576 - RNA, 63 nt, Homo sapiens
uugcuaaaaauauuaagaccaagucaugcaauaauugaauguaccucaaauuuuuaggggagg

SEQ ID NO: 3577 - RNA, 63 nt, Homo sapiens
uugcucucugccacagcuugcagcauggucuugacugaauguacuguuccuguuagcguuacu

SEQ ID NO: 3578 - RNA, 60 nt, Homo sapiens
uugcuguucaaggaaguaaggaggaggaggugauguagcacuuccaagauggcaccagca

SEQ ID NO: 3579 - RNA, 63 nt, Homo sapiens
uuggaaaccaucacuauugagagaugggaaaaaccugaauguauaaagcauuuauuugucaau

SEQ ID NO: 3580 - RNA, 64 nt, Homo sapiens
uuggacccaaguuaggugugacacguucacacgacuauguagcacaugccgggagugaucugcc

SEQ ID NO: 3581 - RNA, 64 nt, Homo sapiens
uuggagauaguuuugguuuguacagaacaaaauaauauguagcagcuucauugcuauuggaaaa

SEQ ID NO: 3582 - RNA, 61 nt, Homo sapiens
uuggagcucaguccacgguccucccccacuggauggugcuacugcuguggaaucuuguaaa

SEQ ID NO: 3583 - RNA, 63 nt, Homo sapiens
uuggcagcaguuuuauaaaguccgucauuugcauuugaauguaaggcucaguaaaugacagaa

SEQ ID NO: 3584 - RNA, 63 nt, Homo sapiens
uuggcuacgcagggaugggcaguugcacgaaggcaugaauguauuguaaauaaguaacuuuga

SEQ ID NO: 3585 - RNA, 62 nt, Homo sapiens
uuggcuauuuuguuggccaaugggacauuaacaaguaugauacaagcagaggcuugagaagu

SEQ ID NO: 3586 - RNA, 63 nt, Homo sapiens
uugggcuuucagauuucucuuuuuaaccacauuucugaauguauaaaaauaccaauuauuuuc

SEQ ID NO: 3587 - RNA, 63 nt, Homo sapiens
uugggucuaaucuuuccccuugacccagaacuuccuccccacaaaaaugccuuuaaaaaccuu

SEQ ID NO: 3588 - RNA, 61 nt, Homo sapiens
uuggucaaacuuuucccauucaaaggaagaagauggugcuacuauagacaguuuuuccccu

SEQ ID NO: 3589 - RNA, 63 nt, Homo sapiens
uuggugcugauagcucucuaaggguagggcacaccuccccacagccacccucccucuucagag

SEQ ID NO: 3590 - RNA, 64 nt, Homo sapiens
uuggugguuaccaaagaguucacaaaacagguuuguauguagcaccuuucaugcaaggcaugca

SEQ ID NO: 3591 - RNA, 62 nt, Homo sapiens
uugguuuuacaggucauuaccagucauuaaaguccaguauuacuaagguaagggauugagga

SEQ ID NO: 3592 - RNA, 62 nt, Homo sapiens
uuguaaaguuuccccucuauuuuggugaccaauacuacuguaaauguauuugguuuuuugca

SEQ ID NO: 3593 - RNA, 62 nt, Homo sapiens
uuguaauauuuaguaagaguauaugaaaggauugcuacuguaucagaaauauuguuucaauu

SEQ ID NO: 3594 - RNA, 61 nt, Homo sapiens
uuguacauguuuacuguuagguccuugcaucuguggugcuaggugaguaugagaagauguc

SEQ ID NO: 3595 - RNA, 62 nt, Homo sapiens
uuguagacucacaaguuuaacuguuguauuauaacaguauuacaugucaacggugugguuau

SEQ ID NO: 3596 - RNA, 63 nt, Homo sapiens
uuguauaauuacuugauucacacagugagaaaaaaugaauguauuccuguuuuugaagagaag

SEQ ID NO: 3597 - RNA, 61 nt, Homo sapiens
uuguauuuaauuaacucccacuagaaccggaaguggugcuauggacgcuuucuaguugaug

SEQ ID NO: 3598 - RNA, 61 nt, Homo sapiens
uuguauuuucuacaucagaguucauagcggggauggugcuacauauaucuaugcaacugaa

SEQ ID NO: 3599 - RNA, 62 nt, Homo sapiens
uugucaaacuuagacacccuugacaacugcacuccuacuguaggcuccugugcauacugucg

SEQ ID NO: 3600 - RNA, 63 nt, Homo sapiens
uugucaaauaaggcuacaguauuugcuuuuuugugugaauguauugcauauaauguucaagua

SEQ ID NO: 3601 - RNA, 63 nt, Homo sapiens
uugucagacuuccaaauccuggaaggacacagugaugaauguacuaugucugaacauagaaac

SEQ ID NO: 3602 - RNA, 63 nt, Homo sapiens
uugucaguaucugcucugaggaaccaggucccaccuccccacaaggcaaaucuagacccauua

SEQ ID NO: 3603 - RNA, 64 nt, Homo sapiens
uugucauaacaucaaaacaagaaauuucuugauggaauguagcaguaaacauaugaaauaaaca

SEQ ID NO: 3604 - RNA, 61 nt, Homo sapiens
uugucauuuuaugaauaucauugauuuuauaauuggugcuauuugaagaaaaaaauguaca

SEQ ID NO: 3605 - RNA, 62 nt, Homo sapiens
uuguccauuuacuauaauuuaucugaccauuucccuacuguaaaauacuuaagacgguuucu

SEQ ID NO: 3606 - RNA, 63 nt, Homo sapiens
uuguccuucugugucuuguagcuguagggugccagcucagggagugggguguuggcggcguuu

SEQ ID NO: 3607 - RNA, 63 nt, Homo sapiens
uugugacgcguuggugacggugcccagccugcgguuccccacagcaucgcaggcgcucggaaa

SEQ ID NO: 3608 - RNA, 61 nt, Homo sapiens
uugugaucuuaguguauauaguuuuuacguuguuggugcuaaagugcuuuuuugaaguuua

SEQ ID NO: 3609 - RNA, 62 nt, Homo sapiens
uugugaugcuucauucuguggaauuuugugcuugcuacuguauagugcaugugguguagguu

SEQ ID NO: 3610 - RNA, 64 nt, Homo sapiens
uuguggagugcaucgaucauaaagcgggagguagacauguagcaguaaaaauaguuaaaaaugu

SEQ ID NO: 3611 - RNA, 64 nt, Homo sapiens
uugugggucuauuucuaguuauuacccagaguuuuuauguagcagggaaaauauauaucuaaau

SEQ ID NO: 3612 - RNA, 62 nt, Homo sapiens
uugugugaagcuauuaaaaugauuguaaaguugacuacuguaaauuucccauaauuaugugu

SEQ ID NO: 3613 - RNA, 63 nt, Homo sapiens
uuguguuaucugcauguuguaacgugugauaagaaugaauguaaaggcuguggcaacuguaau

SEQ ID NO: 3614 - RNA, 63 nt, Homo sapiens
uuguucuuguugcgaagguuucaaauauuugugacugaauguacggugaaacugucauaaugu

SEQ ID NO: 3615 - RNA, 62 nt, Homo sapiens
uuguuggggcuucccugccccuccuggucugugucaguauuaccaccagacugacuccagga

SEQ ID NO: 3616 - RNA, 63 nt, Homo sapiens
uuguuguuuuaagauugugaagugucguuaauggguccccacagauggucccugcuggacuca

SEQ ID NO: 3617 - RNA, 63 nt, Homo sapiens
uuuaaaacaacaaaaagggagggcguugacaccauuccccacagagauagucaugcugagugu

SEQ ID NO: 3618 - RNA, 61 nt, Homo sapiens
uuuaaaaggaaucccaauugcugcaggagcagauggugcuacaggggcaggcaagggcagg

SEQ ID NO: 3619 - RNA, 62 nt, Homo sapiens
uuuaaagauuuaaacuaauuaugcuggcuuuuauguaugauaccuaaucagagcauugacca

SEQ ID NO: 3620 - RNA, 63 nt, Homo sapiens
uuuaaagguagaguuaacagaauauacugguggacugaauguagguugagagaggaagcgaga

SEQ ID NO: 3621 - RNA, 63 nt, Homo sapiens
uuuaacaauucuccuuaaaagauauuuuggagugaugaauguaguuuacuuuuguauuugaau

SEQ ID NO: 3622 - RNA, 63 nt, Homo sapiens
uuuaacuauugauuuuuuuuaaaaaaaauugucuuugaauguauuggaaguagacaugcauua

SEQ ID NO: 3623 - RNA, 63 nt, Homo sapiens
uuuaaggagcauuuaaaaauauguauauaugugacugaauguaagauuaacuuuauuuugguc

SEQ ID NO: 3624 - RNA, 61 nt, Homo sapiens
uuuaauaauauauacaagcuccauaacuccuuuuggugcuaaugauuccgcuauuucacag

SEQ ID NO: 3625 - RNA, 62 nt, Homo sapiens
uuuaauuucaguuguuuguaauaaguagaauacacuacuguaaacauacgaccuuuguuuuu

SEQ ID NO: 3626 - RNA, 62 nt, Homo sapiens
uuuacaacuuacauuuacaauuuauaguguuuaccaguauuaaauucucagccacuccuuuc

SEQ ID NO: 3627 - RNA, 62 nt, Homo sapiens
uuuacaugccacuauauugacuuuaauugauauacaguauuaaguuuuuaggugccauuauu

SEQ ID NO: 3628 - RNA, 63 nt, Homo sapiens
uuuacuauguauuuauacguuaagaccucuaugaaugaauguaucagagaaugucuuuguaac

SEQ ID NO: 3629 - RNA, 63 nt, Homo sapiens
uuuacucucuuuuucuagccuguauaccaggcuuuuccccacauugucagguagagcaccagc

SEQ ID NO: 3630 - RNA, 62 nt, Homo sapiens
uuuagaaaaacuaaugcuuaaaacaauauuugaacuacuguauuuauaauuuauuaccucua

SEQ ID NO: 3631 - RNA, 63 nt, Homo sapiens
uuuagacuucuuaauaaccuaaauauuuaaaauaaugaauguaacaccuuuuuuaguucacug

SEQ ID NO: 3632 - RNA, 56 nt, Homo sapiens
uuuagauagugcugacugauuucuagcccucagggaugaggaugaaaagcuggaaa

SEQ ID NO: 3633 - RNA, 62 nt, Homo sapiens
uuuagauggaaaauuaccucacaucuguuuucuucaguauuacuuaagauuguuuauuuagu

SEQ ID NO: 3634 - RNA, 62 nt, Homo sapiens
uuuauagcuuaacuaauuugaaugugguuacuuccuacuguaggguagcggaaaaguugucu

SEQ ID NO: 3635 - RNA, 62 nt, Homo sapiens
uuuauaguaguuuuuuuguauuuuuuuguaaugacaguauuauguaaaaaauaaaguauuuu

SEQ ID NO: 3636 - RNA, 62 nt, Homo sapiens
uuuauauaucacuauaaaauccaguugaccuggacaguauuauauguacauaucuauucuaa

SEQ ID NO: 3637 - RNA, 62 nt, Homo sapiens
uuuauaugugagcgagcaagccggcaagcgagcacaguauuauuucuccauccccucccugc

SEQ ID NO: 3638 - RNA, 62 nt, Homo sapiens
uuuauccuggugccugauugggguggggacuguccuacuguaaccccugugaaaaaccuuga

SEQ ID NO: 3639 - RNA, 63 nt, Homo sapiens
uuuauguaauuuagggaggacuggucuguaauuucugaauguauauagaauaauauuuauguu

SEQ ID NO: 3640 - RNA, 63 nt, Homo sapiens
uuuauuuauucuuaguauuuaauuuuuaacauccucucagggaccaggggccuccugcuuuuc

SEQ ID NO: 3641 - RNA, 62 nt, Homo sapiens
uuuauuucuacuugaacacuaccucuugugaagucuacuguagauaagacgauugucauuuc

SEQ ID NO: 3642 - RNA, 61 nt, Homo sapiens
uuuauuuuauaaguuagaacuuugaagaggaaauggugcuauauguuuauuguuauuacuu

SEQ ID NO: 3643 - RNA, 62 nt, Homo sapiens
uuucagaacuuguuucuuaucaagaaguuagcagguaugauauguauaucauacguauauaa

SEQ ID NO: 3644 - RNA, 63 nt, Homo sapiens
uuucagcucaauuguuaaugugauggauggcacaaugaauguauauuuuguguuauucgugaa

SEQ ID NO: 3645 - RNA, 63 nt, Homo sapiens
uuucagugaaagaggaaggaaaggaguagggcuagugaauguaucugccaggucuuagaaguc

SEQ ID NO: 3646 - RNA, 62 nt, Homo sapiens
uuucaguguuaacuggguaucaguuaugagucuacuacuguauaauggcauccaaaagaauu

SEQ ID NO: 3647 - RNA, 63 nt, Homo sapiens
uuucauaaaaggacacacacuggagagaaacccugugaauguaagaaauguagaaaagcauuc

SEQ ID NO: 3648 - RNA, 64 nt, Homo sapiens
uuucauaaagcuccauggagaguuuuaaagaaacauauguagcaugauuuuguaggagaggaaa

SEQ ID NO: 3649 - RNA, 62 nt, Homo sapiens
uuucaucucaaaaauaauuuuuaaaaagccugagguaugauauagcauaaaagauugagaug

SEQ ID NO: 3650 - RNA, 62 nt, Homo sapiens
uuuccacccugaaaggaaauguuuuucuuugcagcaguauuagauaaugaaaaaugcuaauu

SEQ ID NO: 3651 - RNA, 63 nt, Homo sapiens
uuuccagggccccacacucacaaaggcuccaggccuccccacagaggacccugccugagcaag

SEQ ID NO: 3652 - RNA, 63 nt, Homo sapiens
uuuccauuuuggcgcuauuacaaauagugcaacuaugaauguacugcauguuaccaucuuacu

SEQ ID NO: 3653 - RNA, 62 nt, Homo sapiens
uuucccgugcucuuugggcuccccagagaccugacaguauuagggagugaagggaggagggg

SEQ ID NO: 3654 - RNA, 62 nt, Homo sapiens
uuucccguggcugccaccagcgaaugaaacuuuuguaugauacauaaagugcuugagucuau

SEQ ID NO: 3655 - RNA, 64 nt, Homo sapiens
uuucccucgaaaacucauguugaaacuuaacuccuaauguagcaguacugagaggcagggcccu

SEQ ID NO: 3656 - RNA, 62 nt, Homo sapiens
uuuccuaauuuuauuuauuucauacuguaguguacaguauuauaguucuucaauauauagau

SEQ ID NO: 3657 - RNA, 63 nt, Homo sapiens
uuuccucuacaaccccaaggacuuucaugauuauccucagggacaggauuggaggcauugagc

SEQ ID NO: 3658 - RNA, 62 nt, Homo sapiens
uuuccucuggauuaaaacuacggacuggggacaacaguauuaauucgauugaauguggcuga

SEQ ID NO: 3659 - RNA, 62 nt, Homo sapiens
uuuccuucuuucuuuucaccuuuagguuaauauccaguauuauguguuaucccuuuggauaa

SEQ ID NO: 3660 - RNA, 63 nt, Homo sapiens
uuucuaggaauguauccugaggaaauuauccgagauccccacaaacugcaauguuuaggaauu

SEQ ID NO: 3661 - RNA, 64 nt, Homo sapiens
uuucuccuggagaaaugaucuaccagucaaggcaauauguagcagaucccugggaauuaaaggu

SEQ ID NO: 3662 - RNA, 63 nt, Homo sapiens
uuucucgaaggugcuuggcggucuugccuucccccuccccacaggcucuccuugugggguccc

SEQ ID NO: 3663 - RNA, 62 nt, Homo sapiens
uuucucuaccugcccuugggcucacuaauaucaccaguauuauuaccaagaaaauauugagu

SEQ ID NO: 3664 - RNA, 63 nt, Homo sapiens
uuucucugggcuuucaaacccacaaccuuuacacacucagggauaccuccgggucugccauga

SEQ ID NO: 3665 - RNA, 63 nt, Homo sapiens
uuucuggacaauuuucagaagaauaggcugccuccuccccacagccugggggaaguaacaguc

SEQ ID NO: 3666 - RNA, 62 nt, Homo sapiens
uuucuucagguuuucuaacaugcuuaccacugggcuacuguaaaugagaaaagaauaaaauu

SEQ ID NO: 3667 - RNA, 62 nt, Homo sapiens
uuucuuugcuuucagcccauguaaauaaauaauacaguauuaacauuuucgugcugcuuccc

SEQ ID NO: 3668 - RNA, 63 nt, Homo sapiens
uuugaaaccuguggcuuucaagcaagguaccguuguccccacaguguuccgugggguaggggg

SEQ ID NO: 3669 - RNA, 63 nt, Homo sapiens
uuugaaccacguaucucuggguagcuacaaaauuccucagggaugucauuuugcaggcauguc

SEQ ID NO: 3670 - RNA, 63 nt, Homo sapiens
uuugaaccacguaucucuggguagcuacaaaauuccucagggauuucauuuugcaggcauguc

SEQ ID NO: 3671 - RNA, 62 nt, Homo sapiens
uuugaauagccuacucccaaguaagagcaaaucuguaugauaacauuuuuuccucuggacau

SEQ ID NO: 3672 - RNA, 63 nt, Homo sapiens
uuugacauggaugauucugaggaggaagcuguuauugaauguauagagauuuauccaaauaaa

SEQ ID NO: 3673 - RNA, 62 nt, Homo sapiens
uuugagaacugccauucaguagagaauuauuugccuacuguaaauuuucuaaggauuuauga

SEQ ID NO: 3674 - RNA, 62 nt, Homo sapiens
uuugagauuuuauuuugugauguauugucuucugcaguauuaaagggaaagagauauuaaug

SEQ ID NO: 3675 - RNA, 61 nt, Homo sapiens
uuugaugauuuguuuggcauauaggaagcacgcuggugcuaaguauuuuuuaaaugguuau

SEQ ID NO: 3676 - RNA, 63 nt, Homo sapiens
uuugaugucaaacgccuugaaaacaagccuccacuuccccacacuucccauuuacucuugaga

SEQ ID NO: 3677 - RNA, 64 nt, Homo sapiens
uuugcaaacuucccucauguaaggaagguacuuuaaauguagcagccacugacauuucuuuuuu

SEQ ID NO: 3678 - RNA, 63 nt, Homo sapiens
uuugcccacgucccgacaacuuguucccugacccccucagggauggccccaaacugucccugc

SEQ ID NO: 3679 - RNA, 64 nt, Homo sapiens
uuugcuggcuaauugacaguauuucucagcaucacuauguagcauucuguuuuagcaucuuuga

SEQ ID NO: 3680 - RNA, 63 nt, Homo sapiens
uuugcuggggggagaugaggcagccucuggaauggcucagggauucagcccucccugccgcug

SEQ ID NO: 3681 - RNA, 63 nt, Homo sapiens
uuugcugucuuuuuacacuguaugcgguuuggaaaugaauguagaaacuuacugugggcauuu

SEQ ID NO: 3682 - RNA, 61 nt, Homo sapiens
uuuggaucuuaugaugcugagcauguucugcacuggugcuaaugucuaauauaauuuuaua

SEQ ID NO: 3683 - RNA, 64 nt, Homo sapiens
uuuggcaauuuauaauuuauuacuacuuuaaaucaaauguagcauuaucacacuguauuuaaau

SEQ ID NO: 3684 - RNA, 62 nt, Homo sapiens
uuuggcagggaaaaagggcaauguugauuaaucucaguauuaaaccacauuaaucuguaucc

SEQ ID NO: 3685 - RNA, 63 nt, Homo sapiens
uuuggcauaaaauacggcuuacguugcuuaagauucucagggauaaacuuccuuuugcuaaau

SEQ ID NO: 3686 - RNA, 62 nt, Homo sapiens
uuuggcauucuauagacacaucuccuauguaugucuacuguaauuaauccaaguuaauaacc

SEQ ID NO: 3687 - RNA, 63 nt, Homo sapiens
uuuggggcaagucauguaaauacuguugguggucuuccccacacgccccaauuuucagguagu

SEQ ID NO: 3688 - RNA, 62 nt, Homo sapiens
uuuggugacucaucaauggauauguguuuuggauguaugauaugcuugguuuaaauucucuu

SEQ ID NO: 3689 - RNA, 62 nt, Homo sapiens
uuuguaagcagguacauuuuauaaaauguaagcccuacuguaagguuuagcacuggguguac

SEQ ID NO: 3690 - RNA, 61 nt, Homo sapiens
uuuguagacaaacaacugauaauaagcuuugaauggugcuaauaagaguaggaauucucuc

SEQ ID NO: 3691 - RNA, 63 nt, Homo sapiens
uuuguauugaaaugaaaccaccaguguuaucaacuugaauguaaauguacaugugcagauauu

SEQ ID NO: 3692 - RNA, 63 nt, Homo sapiens
uuuguauuguaguaaccaauaugugcaguauacguugaauguauaugaacauacuuuccuauu

SEQ ID NO: 3693 - RNA, 62 nt, Homo sapiens
uuuguuaaauauuuugaaauguaaaugaaaagaacuacuguauauuaaaaguugguuugaac

SEQ ID NO: 3694 - RNA, 63 nt, Homo sapiens
uuuuaaaaaaagugaauggacugaaauguuaaaugugaauguacauuucuuaauugcaacuuu

SEQ ID NO: 3695 - RNA, 62 nt, Homo sapiens
uuuuaaaauuccuuuaaaaaaugugcuguuaagccaguauuagguaucuuuauuuuguaagu

SEQ ID NO: 3696 - RNA, 63 nt, Homo sapiens
uuuuaaacaaaugaugcugagaauaaggagagaaaugaauguagagagagguagagagagaaa

SEQ ID NO: 3697 - RNA, 63 nt, Homo sapiens
uuuuaaacacccccaucccucgggaagcagccagcuccccacaccuuccagggcccuaggccc

SEQ ID NO: 3698 - RNA, 61 nt, Homo sapiens
uuuuaauuuuaauauuuguuaucauuuauuuauuggugcuacuguuuauccguaauaauug

SEQ ID NO: 3699 - RNA, 62 nt, Homo sapiens
uuuuacacgaacugaaaugagcaugcauuuucuuguaugauagugacuagcacuagacaugu

SEQ ID NO: 3700 - RNA, 62 nt, Homo sapiens
uuuuacaguggacagccucuucucguuucagccucaguauuauguagggaccuuaugcaauu

SEQ ID NO: 3701 - RNA, 62 nt, Homo sapiens
uuuuagaaaacaaagcauuaaaaaaaaagccuaucaguauuaugggcaauauguaaauaaau

SEQ ID NO: 3702 - RNA, 63 nt, Homo sapiens
uuuuagucaugaguuguuuucaguuuucagacgaaugaauguaauaggaaacuauggaguuac

SEQ ID NO: 3703 - RNA, 64 nt, Homo sapiens
uuuuauaccaauaaaauuuucaaauauugcuaacuaauguagcauuaacuaacgauuggaaacu

SEQ ID NO: 3704 - RNA, 63 nt, Homo sapiens
uuuuaugagggccacgggucuguguucgacucagccucagggacgacucugaccucuuggcca

SEQ ID NO: 3705 - RNA, 63 nt, Homo sapiens
uuuuauguaauaucauguguaccuuuacauuguggugaauguaacaauauauguucuucauau

SEQ ID NO: 3706 - RNA, 63 nt, Homo sapiens
uuuuauuaguauguagaggauuuguaucuaauucaugaauguaguuuuacaguaguuugucau

SEQ ID NO: 3707 - RNA, 62 nt, Homo sapiens
uuuuauucauuguuaucuugccaauggaaauaaaguaugauauugcauuuaaauauuauauu

SEQ ID NO: 3708 - RNA, 63 nt, Homo sapiens
uuuuauuguuaguucucacuuguuuccauauuuagugaauguacauuuaauugcaaagcuguc

SEQ ID NO: 3709 - RNA, 63 nt, Homo sapiens
uuuucaggucauuuccugauagucuagucagcuuaugaauguaagcaaaacaggaccaaugaa

SEQ ID NO: 3710 - RNA, 64 nt, Homo sapiens
uuuucaugcaaauacacacuucuuuccccaaacaucauguagcacaucaauauguagggagaca

SEQ ID NO: 3711 - RNA, 63 nt, Homo sapiens
uuuuccuccauguuauuuaugaauuuuauauuccgugaauguauauugucuuguaauguugca

SEQ ID NO: 3712 - RNA, 64 nt, Homo sapiens
uuuuccucuuggaaauaguacguacuuugcuuugguauguagcaaaaggcuuccauuucuggaa

SEQ ID NO: 3713 - RNA, 63 nt, Homo sapiens
uuuucguugcaugugaugguucuguggacauaugauccccacaaacugugggagugauuggcc

SEQ ID NO: 3714 - RNA, 62 nt, Homo sapiens
uuuucucuugcuuccucuucucuucucccuuaucguaugauagaaagacauucuuccccagg

SEQ ID NO: 3715 - RNA, 61 nt, Homo sapiens
uuuucuuauuuucugguggaggagcuuaguaaguggugcuacaauugcugugcaaagaaau

SEQ ID NO: 3716 - RNA, 64 nt, Homo sapiens
uuuugaaugaaccaauuauacuuuauuuggucuccuauguagcauuucagaaaacaagagaaaa

SEQ ID NO: 3717 - RNA, 63 nt, Homo sapiens
uuuugcaguguuaccagaaucaaggcucuguuuauuccccacaagacuugcauagaaaaauaa

SEQ ID NO: 3718 - RNA, 64 nt, Homo sapiens
uuuugcucacagcugccuuggccccaccccugggagauguagcaaauugaguguggguuuugga

SEQ ID NO: 3719 - RNA, 63 nt, Homo sapiens
uuuuggcacugaaaugguauuugggaagcauuauuugaauguacaguuguuugguuuuguaug

SEQ ID NO: 3720 - RNA, 62 nt, Homo sapiens
uuuuguagaaucucuucaugcuugacauaccuaccaguauuauucccgacgacacauauaca

SEQ ID NO: 3721 - RNA, 62 nt, Homo sapiens
uuuuguaguauuuaauaaucuggauggagccugucaguauuacaguuaguuuucuagugacu

SEQ ID NO: 3722 - RNA, 63 nt, Homo sapiens
uuuuguaucucacaauucuggucuagauucaguuaugaauguaggcauuaguuaaaauuaaca

SEQ ID NO: 3723 - RNA, 63 nt, Homo sapiens
uuuugugccuguuuaaaggcuuuuguuuagcagagugaauguaaaauacaguaaaauguuaag

SEQ ID NO: 3724 - RNA, 62 nt, Homo sapiens
uuuuguucuauggaaucaaauuucucacaaugcuguaugauacuauuuaaauuuggaggaca

SEQ ID NO: 3725 - RNA, 62 nt, Homo sapiens
uuuuguucuguuuuguauuucaauuaggaacuugcaguauuauuuugaaaaccauucuaaaa

SEQ ID NO: 3726 - RNA, 62 nt, Homo sapiens
uuuuguuuuauaaaucauaguaucugucaucuugcaguauuaccaaugcuguuguaaauuga

SEQ ID NO: 3727 - RNA, 63 nt, Homo sapiens
uuuuguuuuaugucagacucucucagugagaaguucucagggacaauaauagcaggggguccu

SEQ ID NO: 3728 - RNA, 64 nt, Homo sapiens
uuuuuaaaaacuacucacaacuagcagauggcuuaaauguagcaaucucugcguuaauuaaaug

SEQ ID NO: 3729 - RNA, 62 nt, Homo sapiens
uuuuuaaagcuauuuuucaaggaaccuuuuuuugcaguauuauugaauuuauuuucuaaauc

SEQ ID NO: 3730 - RNA, 62 nt, Homo sapiens
uuuuuaauuuuuuagucacaggaaauuuuuaacucuacuguagaugcauguccaugcauuuu

SEQ ID NO: 3731 - RNA, 62 nt, Homo sapiens
uuuuuaccaguauaguaaaaaaguagaaaagcaaguaugauauuuuuguaagauaauuuauu

SEQ ID NO: 3732 - RNA, 62 nt, Homo sapiens
uuuuuagcuaaaaagagggacuguuaaauacaauguaugauaccaugacaaaaaucuuuccu

SEQ ID NO: 3733 - RNA, 64 nt, Homo sapiens
uuuuuaguaaagauuaaauccaaaacuuuacuuuuaauguagcacagaauaguuuuaaugagaa

SEQ ID NO: 3734 - RNA, 61 nt, Homo sapiens
uuuuuauucagugugaacugucaguaucuauucuggugcuaaauguauggugcuaaaugaa

SEQ ID NO: 3735 - RNA, 62 nt, Homo sapiens
uuuuucaauugacaagacuuuaagucagggauaacaguauuaauguucucuguucuguuucc

SEQ ID NO: 3736 - RNA, 63 nt, Homo sapiens
uuuuucauuuuuuuacuuuguaguuuauuuuuuagugaauguauuuaauuuuaugaauuauuu

SEQ ID NO: 3737 - RNA, 62 nt, Homo sapiens
uuuuuccuaguugaugccuuccuuuauuacaaaucaguauuaaaacuuccagauuauauucu

SEQ ID NO: 3738 - RNA, 63 nt, Homo sapiens
uuuuugaacuaaauaguggugauggcuacacauugugaauguaauuaacaccacugaguuaaa

SEQ ID NO: 3739 - RNA, 63 nt, Homo sapiens
uuuuugagaugaaacuuuuucccagcaaagucuuuuccccacagugaugcucugaaagccagg

SEQ ID NO: 3740 - RNA, 64 nt, Homo sapiens
uuuuugaguuaaaaauggcacuuuugauaugagacaauguagcagaauaccaggcagacagaac

SEQ ID NO: 3741 - RNA, 63 nt, Homo sapiens
uuuuugguguuccaaugaaucugggauguaaacucugaauguauuuauaacuauuuauuucug

SEQ ID NO: 3742 - RNA, 62 nt, Homo sapiens
uuuuuguuugauguaaucaauaaacuuugguaugauaugauugaugguaccuaguguuaaac

SEQ ID NO: 3743 - RNA, 61 nt, Homo sapiens
uuuuuuaccaauuccaauuucaaaaugucucaauggugcuauaauaaauaaacuucaacac

SEQ ID NO: 3744 - RNA, 62 nt, Homo sapiens
uuuuuucaaaaaugaauuuuuauuuaaugugguucaguauuauaauaacaaagcauuuuugu

SEQ ID NO: 3745 - RNA, 63 nt, Homo sapiens
uuuuuucaugaaaauuauuggugggccacugaaaguccccacacacaaagccuuuauucuaua

SEQ ID NO: 3746 - RNA, 63 nt, Homo sapiens
uuuuuuccccucacauugaauuuuaauuccauucuugaauguagaaauuucagauucucuaaa

SEQ ID NO: 3747 - RNA, 63 nt, Homo sapiens
uuuuuugaaauuacauugcuuguuuaucagacaauugaauguaguaauucuguucuggauuua

SEQ ID NO: 3748 - RNA, 61 nt, Homo sapiens
uuuuuugaaccccauucuuuccuucucugaaaguggugcuauaaguuuuagaaucuuuuaa

SEQ ID NO: 3749 - RNA, 62 nt, Homo sapiens
uuuuuugccaaccauugccaaugucaaucaaucacaguauuagccucuguuaaucuauuuac

SEQ ID NO: 3750 - RNA, 62 nt, Homo sapiens
uuuuuuguucgguacaauaaaguuuacuaaaaaacaguauuaggguuuauuuggaguuaacu

SEQ ID NO: 3751 - RNA, 63 nt, Homo sapiens
uuuuuuuuaauacauauccaauaaugccuuccaucugaauguaaaauaaguacccaugauuuc

The invention claimed is:

1. An isolated nucleic acid comprising a sequence selected from the group consisting of:
   (a) SEQ ID NO: 14;
   (b) complement of (a); and
   (c) sequence at least 80% identical to (a) or (b), wherein the nucleic acid is from 18 to 100 nucleotides in length.

2. The nucleic acid of claim 1 wherein the nucleic acid comprises a modified base.

3. A probe comprising a heterologous sequence, wherein the heterologous sequence consists of the sequence of the nucleic acid of claim 1.

4. The probe of claim 3, wherein the nucleic acid is a miRNA.

5. A biochip comprising the probe of claim 3.

6. A vector comprising a heterologous sequence, wherein the heterolgous sequence consists of the sequence of the nucleic acid of claim of 1.

* * * * *